US012466892B2

(12) United States Patent
Lim et al.

(10) Patent No.: US 12,466,892 B2
(45) Date of Patent: Nov. 11, 2025

(54) SYSTEMS AND METHODS FOR TARGETING CANCER CELLS

(71) Applicants: The Regents of the University of California, Oakland, CA (US); The Trustees of Princeton University, Princeton, NJ (US); The Simons Foundation, Inc., New York, NY (US)

(72) Inventors: Wendell A. Lim, San Francisco, CA (US); Olga G. Troyanskaya, Princeton, NJ (US); Benjamin Vandersluis, New York, NY (US); Ruth Dannenfelser, Princeton, NJ (US)

(73) Assignees: THE REGENTS OF THE UNIVERSITY OF CALIFORNIA, Oakland, CA (US); THE TRUSTEES OF PRINCETON UNIVERSITY, Princeton, NJ (US); THE SIMONS FOUNDATION, INC., New York, NY (US)

( * ) Notice: Subject to any disclaimer, the term of this patent is extended or adjusted under 35 U.S.C. 154(b) by 1125 days.

(21) Appl. No.: 17/291,794

(22) PCT Filed: Nov. 7, 2019

(86) PCT No.: PCT/US2019/060357

§ 371 (c)(1),
(2) Date: May 6, 2021

(87) PCT Pub. No.: WO2020/097395

PCT Pub. Date: May 14, 2020

(65) Prior Publication Data

US 2022/0127373 A1 Apr. 28, 2022

Related U.S. Application Data

(60) Provisional application No. 62/757,595, filed on Nov. 8, 2018.

(51) Int. Cl.

| | |
|---|---|
| ***A61K 39/00*** | (2006.01) |
| ***A61K 40/11*** | (2025.01) |
| ***A61K 40/31*** | (2025.01) |
| ***A61K 40/42*** | (2025.01) |
| ***A61P 35/00*** | (2006.01) |
| ***C07K 14/725*** | (2006.01) |
| ***C07K 16/28*** | (2006.01) |
| ***C07K 16/30*** | (2006.01) |
| ***C07K 16/40*** | (2006.01) |

(52) U.S. Cl.

CPC .......... *C07K 16/3015* (2013.01); *A61K 39/00* (2013.01); *A61K 39/0011* (2013.01); *A61K 40/11* (2025.01); *A61K 40/31* (2025.01); *A61K 40/4202* (2025.01); *A61P 35/00* (2018.01); *C07K 14/7051* (2013.01); *C07K 16/28* (2013.01); *C07K 16/40* (2013.01); *A61K 2239/31* (2023.05); *A61K 2239/38* (2023.05); *A61K 2239/47* (2023.05); *A61K 2239/49* (2023.05); *A61K 2239/54* (2023.05); *C07K 2317/31* (2013.01); *C07K 2317/622* (2013.01); *C07K 2319/00* (2013.01)

(58) Field of Classification Search

CPC ............ C07K 16/3015; C07K 14/7051; C07K 16/28; A61K 39/00; A61K 39/0011; A61K 39/4611; A61K 39/4631; A61K 39/464402; A61K 2239/47; A61K 48/00; A61P 35/00

USPC ...................................................... 424/138.1

See application file for complete search history.

(56) References Cited

FOREIGN PATENT DOCUMENTS

| | | | | |
|---|---|---|---|---|
| WO | WO 2009/018386 A1 | 2/2009 | | |
| WO | WO-2016123122 A1 * | 8/2016 | ............ | A61K 35/17 |
| WO | WO 2016146259 | 9/2016 | | |
| WO | WO 2017/180587 A2 | 10/2017 | | |
| WO | WO 2017/193059 A1 | 11/2017 | | |
| WO | WO 2018189148 | 10/2018 | | |
| WO | WO 2019/195596 A1 | 10/2019 | | |

OTHER PUBLICATIONS

Boussiotis et al., "Immunotherapies for malignant glioma", Oncogene, 2018, 37: 1121-1141.

(Continued)

*Primary Examiner* — Yan Xiao

(74) *Attorney, Agent, or Firm* — James S. Keddie; Bozicevic, Field & Francis LLP

(57) ABSTRACT

The present disclosure provides immune cells genetically modified to produce two antigentriggered polypeptides, each recognizing a different cell surface antigen, wherein the two different cell surface antigens employed are selected from those pairs described herein. The present disclosure further provides systems comprising two antigen-triggered polypeptides (or nucleic acids encoding same), each recognizing a different cell surface antigen, wherein the two different cell surface antigens employed are selected from those pairs described herein. Also provided are method of killing a target cancer cell, using the described genetically modified immune cells and/or systems. The present disclosure also provides poly specific-immune inducing polypeptides including first and second antigen binding domains specific for first and second antigens, respectively, present on the surface of a target cancer cell.

3 Claims, 89 Drawing Sheets

Specification includes a Sequence Listing.

(56) References Cited

OTHER PUBLICATIONS

Dannenfelser et al., "Discriminatory Power of Combinatorial Antigen Recognition in Cancer T Cell Therapies", Cell Systems, Sep. 23, 2020, 11: 215-228.
Autelitano et al., "Identification of Novel Tumor-Associated Cell Surface Sialoglycoproteins in Human Glioblastoma Tumors Using Quantitative Proteomics", PLOS ONE, 2014, 9(10): e110316.
Dutoit et al., "Antigenic expression and spontaneous immune responses support the use of a selected peptide set from the IMA950 glioblastoma vaccine for immunotherapy of grade II and III glioma", OncoImmunology, 2018, 7(2):e1391970 (10 pages).

* cited by examiner

FIG. 1

| Antigen Pair Logic | Exemplary Cancer Type | f1_min | f05_min | P_train | R_train | P_test | R_test | gid |
|---|---|---|---|---|---|---|---|---|
| (FAP AND CLDN3) | Breast Cancer | 0.58156 | 0.776515 | 0.93 | 0.8 | 1 | 0.41 | 1.37E+09 |
| (CA9 AND IL13RA2) | Glioblastoma | 0.467257 | 0.622642 | 0.79 | 0.41 | 0.8 | 0.33 | 7.68E+08 |
| (PTPRZ1 AND DLL3) | Glioblastoma | 0.824727 | 0.815827 | 0.81 | 0.84 | 1 | 0.83 | 5.8E+09 |
| (PTPRZ1 AND EPHA2) | Glioblastoma | 0.76987 | 0.775916 | 0.78 | 0.76 | 1 | 0.67 | 1.97E+09 |
| (PTPRZ1 AND GPC3) | Glioblastoma | 0.746667 | 0.777778 | 0.8 | 0.7 | 1 | 0.62 | 2.72E+09 |
| (PTPRZ1 AND IL13RA2) | Glioblastoma | 0.809816 | 0.772834 | 0.75 | 0.88 | 1 | 0.71 | 3.6E+09 |
| (PTPRZ1 AND MSLN) | Glioblastoma | 0.802395 | 0.819494 | 0.83 | 0.78 | 1 | 0.67 | 5.8E+09 |
| (PTPRZ1 AND ROR1) | Glioblastoma | 0.781146 | 0.749633 | 0.73 | 0.84 | 1 | 0.75 | 4.92E+09 |
| (CDH10 AND KDR) | Glioma | 0.81561 | 0.781308 | 0.93 | 0.94 | 0.76 | 0.88 | 1.01E+09 |
| (CDH10 AND ROR1) | Glioma | 0.789686 | 0.752758 | 0.93 | 0.94 | 0.73 | 0.86 | 1.01E+09 |
| (PTPRZ1 AND DLL3) | Glioma | 0.852558 | 0.902956 | 0.99 | 0.93 | 0.94 | 0.78 | 5.8E+09 |
| (FAP AND CD274) | Non Small Cell Lung Cancer | 0.391011 | 0.494318 | 0.6 | 0.29 | 0.7 | 0.68 | 2.19E+09 |
| (FCRL5 AND EGFR) | Non Small Cell Lung Cancer | 0.406452 | 0.320482 | 0.28 | 0.76 | 0.3 | 0.63 | 1.96E+09 |
| (MSLN AND FAP) | Ovarian Cancer | | | 0.58 | 0.79 | 0 | 0 | 2.19E+09 |
| (FAP AND PSCA) | Pancreatic Ductal Carcinoma | 0.463366 | 0.559809 | 0.65 | 0.36 | 1 | 0.45 | 2.19E+09 |
| (CD70 AND CA9) | Renal Cell Carcinoma | 0.496241 | 0.669565 | 0.77 | 0.44 | 1 | 0.33 | 7.68E+08 |
| (CD70 AND FOLR1) | Renal Cell Carcinoma | 0.496241 | 0.684733 | 0.78 | 0.46 | 1 | 0.33 | 9.7E+08 |
| (BIRC5 AND B4GALNT1) | Soft Tissue Sarcoma | 0.583898 | 0.567344 | 0.53 | 0.79 | 0.65 | 0.53 | 3.32E+08 |
| (PMEPA1 AND ERBB2) | Breast Cancer | 0.602791 | 0.673885 | 0.65 | 0.79 | 0.81 | 0.48 | 2.06E+09 |
| (PMEPA1 AND MSLN) | Breast Cancer | 0.613984 | 0.587731 | 0.55 | 0.81 | 0.64 | 0.59 | 1.02E+10 |
| (BCAN AND DLL3) | Glioblastoma | 0.812515 | 0.840355 | 0.86 | 0.77 | 0.91 | 0.88 | 1.07E+10 |
| (BCAN AND EGFR) | Glioblastoma | 0.812195 | 0.862694 | 0.9 | 0.74 | 1 | 0.79 | 1.96E+09 |
| (BCAN AND EGFR) | Glioblastoma | 0.812195 | 0.862694 | 0.9 | 0.74 | 1 | 0.79 | 1.96E+09 |
| (BCAN AND EPHA2) | Glioblastoma | 0.806914 | 0.837949 | 0.86 | 0.76 | 0.91 | 0.83 | 1.97E+09 |
| (BCAN AND MSLN) | Glioblastoma | 0.799752 | 0.84047 | 0.87 | 0.74 | 0.95 | 0.79 | 1.02E+10 |
| (BCAN AND MUC1) | Glioblastoma | 0.825663 | 0.863098 | 0.89 | 0.77 | 0.9 | 0.79 | 4.58E+09 |
| (MLC1 AND EPHA2) | Glioblastoma | 0.759868 | 0.753916 | 0.75 | 0.77 | 0.94 | 0.71 | 1.97E+09 |
| (MLC1 AND GPC3) | Glioblastoma | 0.746667 | 0.777778 | 0.8 | 0.7 | 0.89 | 0.71 | 2.72E+09 |
| (NLGN3 AND B4GALNT1) | Glioblastoma | 0.670519 | 0.704984 | 0.73 | 0.62 | 0.75 | 0.62 | 2.58E+09 |
| (NLGN3 AND ERBB2) | Glioblastoma | 0.688429 | 0.745975 | 0.79 | 0.61 | 0.83 | 0.62 | 2.06E+09 |
| (NRCAM AND EGFR) | Glioblastoma | 0.818182 | 0.835922 | 0.84 | 0.82 | 0.9 | 0.75 | 1.96E+09 |
| (NRCAM AND EGFR) | Glioblastoma | 0.818182 | 0.835922 | 0.84 | 0.82 | 0.9 | 0.75 | 1.96E+09 |
| (NRCAM AND EPHA2) | Glioblastoma | 0.738784 | 0.745812 | 0.74 | 0.77 | 0.77 | 0.71 | 1.97E+09 |
| (NRCAM AND ERBB2) | Glioblastoma | 0.746667 | 0.777778 | 0.8 | 0.7 | 1 | 0.62 | 2.06E+09 |
| (NRCAM AND IL13RA2) | Glioblastoma | 0.729252 | 0.712594 | 0.69 | 0.82 | 0.8 | 0.67 | 3.6E+09 |
| (CLDN15 AND GPC3) | Hepatocellular Carcinoma | 0.6 | 0.6 | 0.6 | 0.6 | 0.73 | 0.8 | 2.72E+09 |
| (MET AND NOT-TPBG) | Hepatocellular Carcinoma | 0.664366 | 0.783555 | 0.89 | 0.53 | 1 | 0.5 | 4.23E+09 |
| (CDH6 AND CA9) | Renal Cell Carcinoma | 0.734177 | 0.82 | 0.82 | 0.82 | 1 | 0.58 | 7.68E+08 |
| (CSF3R AND CD70) | Acute Myeloid Leukemia | 0.859884 | 0.853926 | 0.88 | 0.91 | 0.85 | 0.87 | 9.7E+08 |
| (NOT-CADM1 AND CD70) | Acute Myeloid Leukemia | 0.86954 | 0.85771 | 0.85 | 0.9 | 0.85 | 0.89 | 9.7E+08 |
| (NOT-HEG1 AND MUC1) | Acute Myeloid Leukemia | 0.806135 | 0.859948 | 0.89 | 0.89 | 0.9 | 0.73 | 4.58E+09 |
| (CCR5 AND MET) | Breast Cancer | 0.505794 | 0.443607 | 0.41 | 0.66 | 0.54 | 0.81 | 1.23E+09 |
| (CD84 AND MET) | Breast Cancer | 0.51633 | 0.453871 | 0.42 | 0.67 | 0.52 | 0.61 | 4.23E+09 |
| (CXCL9 AND ERBB2) | Breast Cancer | 0.630137 | 0.64115 | 0.63 | 0.69 | 1 | 0.46 | 2.06E+09 |
| (KCNK15 AND MSLN) | Breast Cancer | 0.57871 | 0.684733 | 0.85 | 0.5 | 0.78 | 0.46 | 1.02E+10 |
| (LPAR2 AND MET) | Breast Cancer | 0.538462 | 0.460526 | 0.42 | 0.75 | 0.61 | 0.61 | 4.23E+09 |
| (SLC38A1 AND MET) | Breast Cancer | 0.452903 | 0.501429 | 0.55 | 0.55 | 0.54 | 0.39 | 4.23E+09 |
| (SLC5A6 AND ERBB2) | Breast Cancer | 0.621972 | 0.700973 | 0.67 | 0.86 | 0.96 | 0.46 | 2.06E+09 |
| (SLC5A6 AND MSLN) | Breast Cancer | 0.526094 | 0.679471 | 0.65 | 0.83 | 0.91 | 0.37 | 8.88E+09 |
| (TNFSF4 AND MET) | Breast Cancer | 0.524952 | 0.527969 | 0.53 | 0.52 | 0.72 | 0.81 | 4.23E+09 |
| (AMIGO2 AND CEACAM5) | Colon Cancer | 0.870056 | 0.807128 | 0.77 | 1 | 0.77 | 1 | 1.05E+09 |
| (BFAR AND EGFR) | Colon Cancer | 0.456522 | 0.433884 | 0.5 | 0.5 | 0.42 | 0.5 | 1.96E+09 |
| (NOT-GPR1 AND EGFR) | Colon Cancer | 0.418605 | 0.381356 | 0.36 | 0.5 | 0.42 | 0.5 | 1.96E+09 |
| (NOT-KCNJ5 AND EGFR) | Colon Cancer | 0.335294 | 0.360759 | 0.75 | 0.3 | 0.38 | 0.3 | 1.96E+09 |
| (NOT-LIFR AND FAP) | Colon Cancer | 0.888889 | 0.952381 | 1 | 0.8 | 1 | 0.8 | 2.19E+09 |
| (NOT-PCDH9 AND EGFR) | Colon Cancer | 0.382716 | 0.335498 | 0.38 | 0.5 | 0.31 | 0.5 | 1.96E+09 |
| (NOT-SLC46A1 AND EGFR) | Colon Cancer | 0.428571 | 0.576923 | 1 | 0.3 | 0.75 | 0.3 | 1.96E+09 |
| (PSCA AND DLL4) | Gastric Cancer | 0.44 | 0.44 | 0.42 | 0.58 | 0.44 | 0.44 | 8E+09 |
| (AQP4 AND B4GALNT1) | Glioblastoma | 0.663158 | 0.642857 | 0.63 | 0.7 | 0.67 | 0.83 | 3.61E+08 |
| (AQP4 AND IL13RA2) | Glioblastoma | 0.719444 | 0.70765 | 0.7 | 0.74 | 0.86 | 0.79 | 3.61E+08 |

FIG. 1 (cont.)

| Antigen Pair Logic | Exemplary Cancer Type | f1_min | f05_min | P_train | R_train | P_test | R_test | gid |
|---|---|---|---|---|---|---|---|---|
| (B4GALNT1 AND ADAM17) | Glioblastoma | 0.657576 | 0.68239 | 0.7 | 0.62 | 0.95 | 0.75 | 2.58E+09 |
| (BEST3 AND IL13RA2) | Glioblastoma | 0.674963 | 0.671976 | 0.67 | 0.68 | 0.82 | 0.58 | 3.6E+09 |
| (CDH10 AND F2R) | Glioblastoma | 0.739459 | 0.751648 | 0.76 | 0.72 | 1 | 0.62 | 1.01E+09 |
| (CDH10 AND MMP14) | Glioblastoma | 0.630137 | 0.763222 | 0.81 | 0.62 | 1 | 0.46 | 1.01E+09 |
| (CRB1 AND EGFR) | Glioblastoma | 0.824096 | 0.86802 | 0.9 | 0.76 | 1 | 0.75 | 1.96E+09 |
| (CRB1 AND EGFR) | Glioblastoma | 0.824096 | 0.86802 | 0.9 | 0.76 | 1 | 0.75 | 1.96E+09 |
| (CRB1 AND EPHA2) | Glioblastoma | 0.744698 | 0.753804 | 0.76 | 0.73 | 0.89 | 0.71 | 1.97E+09 |
| (GPM6A AND GPC3) | Glioblastoma | 0.76 | 0.76 | 0.76 | 0.76 | 0.85 | 0.71 | 2.72E+09 |
| (GRIK5 AND ERBB2) | Glioblastoma | 0.747179 | 0.807867 | 0.83 | 0.73 | 0.94 | 0.62 | 2.06E+09 |
| (ITGB8 AND IL13RA2) | Glioblastoma | 0.658636 | 0.64115 | 0.63 | 0.69 | 0.78 | 0.58 | 3.6E+09 |
| (NLGN4X AND EGFR) | Glioblastoma | 0.812195 | 0.862694 | 0.9 | 0.74 | 0.95 | 0.75 | 1.96E+09 |
| (NLGN4X AND EGFR) | Glioblastoma | 0.812195 | 0.862694 | 0.9 | 0.74 | 0.95 | 0.75 | 1.96E+09 |
| (NRSN2 AND ERBB2) | Glioblastoma | 0.62 | 0.62 | 0.85 | 0.68 | 0.62 | 0.62 | 2.06E+09 |
| (PDPN AND B4GALNT1) | Glioblastoma | 0.648507 | 0.726589 | 0.79 | 0.55 | 0.87 | 0.54 | 2.58E+09 |
| (SEMA5B AND ERBB2) | Glioblastoma | 0.669851 | 0.663905 | 0.66 | 0.68 | 0.84 | 0.67 | 2.06E+09 |
| (SLC6A1 AND MUC1) | Glioblastoma | 0.823515 | 0.809524 | 0.8 | 0.85 | 0.86 | 0.79 | 4.58E+09 |
| (TTYH3 AND B4GALNT1) | Glioblastoma | 0.666667 | 0.767178 | 0.82 | 0.61 | 1 | 0.5 | 2.58E+09 |
| (CDH10 AND MAGEA1) | Glioma | 0.55678 | 0.649209 | 0.94 | 0.94 | 0.73 | 0.45 | 1.01E+09 |
| (GPM6A AND ERBB2) | Glioma | 0.847059 | 0.818182 | 0.95 | 0.99 | 0.8 | 0.9 | 2.06E+09 |
| (GPM6A AND KDR) | Glioma | 0.849711 | 0.786938 | 0.95 | 0.99 | 0.75 | 0.98 | 2.82E+09 |
| (GPM6A AND ROR1) | Glioma | 0.825595 | 0.765453 | 0.94 | 0.99 | 0.73 | 0.95 | 2.82E+09 |
| (GPR19 AND KDR) | Glioma | 0.84355 | 0.823095 | 0.92 | 0.93 | 0.81 | 0.88 | 2.84E+09 |
| (GPR19 AND MSLN) | Glioma | 0.779872 | 0.773919 | 0.9 | 0.93 | 0.77 | 0.79 | 2.84E+09 |
| (GPR19 AND ROR1) | Glioma | 0.811288 | 0.779717 | 0.85 | 0.93 | 0.76 | 0.87 | 2.84E+09 |
| (NLGN1 AND DLL3) | Glioma | 0.808098 | 0.855325 | 0.95 | 0.93 | 0.89 | 0.74 | 1.07E+10 |
| (SLC1A3 AND MSLN) | Glioma | 0.808025 | 0.784772 | 0.93 | 0.97 | 0.77 | 0.85 | 6.51E+09 |
| (ABCC6 AND GPC3) | Hepatocellular Carcinoma | 0.666383 | 0.584328 | 0.54 | 0.87 | 0.9 | 0.9 | 3.68E+08 |
| (ACSL6 AND EPCAM) | Hepatocellular Carcinoma | 0.075 | 0.065217 | 0.32 | 0.4 | 0.06 | 0.1 | 4.07E+09 |
| (C1QTNF1 AND EPCAM) | Hepatocellular Carcinoma | | | 0.5 | 0.2 | 0 | 0 | 4.07E+09 |
| (GPR88 AND EPCAM) | Hepatocellular Carcinoma | 0.125926 | 0.149123 | 0.46 | 0.4 | 0.17 | 0.1 | 4.07E+09 |
| (PAQR9 AND EPCAM) | Hepatocellular Carcinoma | 0.285714 | 0.384615 | 0.5 | 0.47 | 0.5 | 0.2 | 4.07E+09 |
| (SLC2A2 AND GPC3) | Hepatocellular Carcinoma | 0.683265 | 0.589437 | 0.54 | 0.93 | 1 | 0.9 | 2.72E+09 |
| (SLC30A10 AND GPC3) | Hepatocellular Carcinoma | 0.6 | 0.6 | 0.62 | 0.67 | 0.6 | 0.6 | 2.72E+09 |
| (SLCO1B1 AND GPC3) | Hepatocellular Carcinoma | 0.684211 | 0.575221 | 0.52 | 1 | 0.9 | 0.9 | 2.72E+09 |
| (NOT-FXYD3 AND EPCAM) | Hepatocellular Carcinoma | 0.033333 | 0.02381 | 0.21 | 0.4 | 0.02 | 0.1 | 4.07E+09 |
| (BAMBI AND B4GALNT1) | Melanoma | 0.62069 | 0.803571 | 0.93 | 0.74 | 1 | 0.45 | 2.58E+09 |
| (C11orf24 AND KDR) | Melanoma | 0.819878 | 0.813923 | 0.81 | 0.83 | 1 | 0.82 | 3.79E+09 |
| (GPR19 AND ERBB2) | Melanoma | 0.8 | 0.8 | 0.8 | 0.8 | 1 | 0.82 | 2.06E+09 |
| (ST3GAL5 AND FAP) | Melanoma | 0.843931 | 0.930456 | 0.97 | 0.8 | 1 | 0.73 | 2.19E+09 |
| (TNFSF9 AND MET) | Melanoma | 0.804224 | 0.789512 | 0.78 | 0.83 | 1 | 0.73 | 4.23E+09 |
| (NOT-ADAM29 AND MET) | Melanoma | 0.709677 | 0.765814 | 0.74 | 0.89 | 1 | 0.55 | 4.23E+09 |
| (NOT-ADAM29 AND ROR1) | Melanoma | 0.768831 | 0.751269 | 0.74 | 0.8 | 1 | 1 | 4.92E+09 |
| (NOT-CDH10 AND MAGEA1) | Melanoma | 0.165138 | 0.330882 | 1 | 0.26 | 1 | 0.09 | 1.01E+09 |
| (NOT-KCNB1 AND B4GALNT1) | Melanoma | 0.496552 | 0.585889 | 0.59 | 0.57 | 0.8 | 0.36 | 2.58E+09 |
| (NOT-NTRK3 AND B4GALNT1) | Melanoma | 0.581695 | 0.543038 | 0.52 | 0.66 | 0.64 | 0.64 | 2.58E+09 |
| (NOT-NTRK3 AND ERBB2) | Melanoma | 0.802099 | 0.852625 | 0.93 | 0.71 | 0.89 | 0.73 | 2.06E+09 |
| (NOT-SCN4A AND MET) | Melanoma | 0.709677 | 0.785917 | 0.79 | 0.77 | 1 | 0.55 | 4.23E+09 |
| (NOT-SLC8A3 AND B4GALNT1) | Melanoma | 0.579833 | 0.522372 | 0.49 | 0.71 | 1 | 0.64 | 2.58E+09 |
| (NOT-SYT13 AND B4GALNT1) | Melanoma | 0.52381 | 0.509259 | 0.53 | 0.71 | 0.5 | 0.55 | 2.58E+09 |
| (NOT-TMEM150B AND MET) | Melanoma | 0.709677 | 0.710835 | 0.67 | 0.94 | 1 | 0.55 | 4.23E+09 |
| (NOT-TSPAN1 AND ERBB2) | Melanoma | 0.809877 | 0.81592 | 0.82 | 0.8 | 1 | 0.73 | 2.06E+09 |
| (DIABLO AND B4GALNT1) | Neuroblastoma | 0.903646 | 0.925113 | 0.94 | 0.87 | 0.98 | 0.84 | 2.58E+09 |
| (DIABLO AND DLL3) | Neuroblastoma | 0.870795 | 0.927724 | 0.95 | 0.87 | 0.97 | 0.79 | 1.07E+10 |
| (DIABLO AND GPC3) | Neuroblastoma | 0.852558 | 0.902956 | 0.93 | 0.86 | 0.94 | 0.78 | 2.72E+09 |
| (DIABLO AND MSLN) | Neuroblastoma | 0.819162 | 0.89295 | 0.91 | 0.88 | 0.95 | 0.72 | 1.02E+10 |
| (GPR19 AND KDR) | Neuroblastoma | 0.808889 | 0.791304 | 0.93 | 0.9 | 0.78 | 0.84 | 2.84E+09 |
| (SCN3A AND GPC3) | Neuroblastoma | 0.781146 | 0.749633 | 0.95 | 0.96 | 0.73 | 0.84 | 2.72E+09 |
| (ADAM12 AND CD80) | Non Small Cell Lung Cancer | 0.45913 | 0.471429 | 0.48 | 0.44 | 0.51 | 0.61 | 9.41E+08 |
| (ADAM12 AND CD86) | Non Small Cell Lung Cancer | 0.454792 | 0.527295 | 0.59 | 0.37 | 0.61 | 0.79 | 9.42E+08 |
| (IL2RA AND EGFR) | Non Small Cell Lung Cancer | 0.40122 | 0.43984 | 0.65 | 0.31 | 0.47 | 0.35 | 1.96E+09 |

FIG. 1 (cont.)

| Antigen Pair Logic | Exemplary Cancer Type | f1_min | f05_min | P_train | R_train | P_test | R_test | gid |
|---|---|---|---|---|---|---|---|---|
| (KISS1R AND EGFR) | Non Small Cell Lung Cancer | 0.482474 | 0.50431 | 0.81 | 0.4 | 0.52 | 0.45 | 1.96E+09 |
| (NOT-ADCY4 AND CD274) | Non Small Cell Lung Cancer | 0.459167 | 0.408148 | 0.46 | 0.46 | 0.38 | 0.58 | 2.91E+10 |
| (NOT-CADM3 AND EGFR) | Non Small Cell Lung Cancer | 0.408 | 0.357089 | 0.31 | 0.91 | 0.34 | 0.51 | 1.96E+09 |
| (NOT-CD101 AND CD274) | Non Small Cell Lung Cancer | 0.399 | 0.387379 | 0.38 | 0.42 | 0.5 | 0.55 | 9.4E+09 |
| (NOT-CD36 AND CD274) | Non Small Cell Lung Cancer | 0.438202 | 0.40795 | 0.39 | 0.5 | 0.57 | 0.53 | 9.48E+08 |
| (NOT-CYP4F12 AND EGFR) | Non Small Cell Lung Cancer | 0.42 | 0.323077 | 0.28 | 0.84 | 0.31 | 0.88 | 1.96E+09 |
| (NOT-MAL AND CD274) | Non Small Cell Lung Cancer | 0.420235 | 0.395133 | 0.38 | 0.47 | 0.44 | 0.58 | 4.12E+09 |
| (NOT-TMEM17 AND GPC3) | Non Small Cell Lung Cancer | | | 0.88 | 0.39 | 0 | 0 | 2.72E+09 |
| (ITGB8 AND FOLR1) | Ovarian Cancer | 0.148148 | 0.30303 | 0.64 | 0.81 | 1 | 0.08 | 2.35E+09 |
| (KCNA6 AND FOLR1) | Ovarian Cancer | 0.148148 | 0.30303 | 0.81 | 0.66 | 1 | 0.08 | 2.35E+09 |
| (KCNK15 AND FOLR1) | Ovarian Cancer | 0.290598 | 0.505952 | 0.89 | 0.94 | 1 | 0.17 | 2.35E+09 |
| (PTH2R AND FOLR1) | Ovarian Cancer | 0.148148 | 0.30303 | 0.86 | 0.58 | 1 | 0.08 | 2.35E+09 |
| (RET AND FOLR1) | Ovarian Cancer | 0.148148 | 0.30303 | 0.81 | 0.79 | 1 | 0.08 | 2.35E+09 |
| (LRRTM1 AND NOT-CDH10) | Ovarian Cancer | 0.270968 | 0.223404 | 0.91 | 0.79 | 0.2 | 0.42 | 1.01E+09 |
| (GP2 AND MSLN) | Pancreatic Ductal Carcinoma | 0.528302 | 0.510949 | 0.5 | 0.56 | 0.5 | 0.64 | 2.81E+09 |
| (GP2 AND PSCA) | Pancreatic Ductal Carcinoma | 0.476863 | 0.413605 | 0.38 | 0.64 | 0.42 | 0.73 | 2.81E+09 |
| (KCNE4 AND CLDN18) | Pancreatic Ductal Carcinoma | 0.550862 | 0.636454 | 0.66 | 0.58 | 0.71 | 0.45 | 2.37E+10 |
| (NOX4 AND PSCA) | Pancreatic Ductal Carcinoma | 0.497455 | 0.419632 | 0.38 | 0.72 | 0.41 | 0.82 | 8E+09 |
| (PPAPDC1A AND PSCA) | Pancreatic Ductal Carcinoma | 0.432 | 0.490909 | 0.54 | 0.36 | 0.56 | 0.45 | 8E+09 |
| (TNFSF4 AND CLDN18) | Pancreatic Ductal Carcinoma | 0.574609 | 0.583746 | 0.59 | 0.56 | 1 | 0.45 | 7.29E+09 |
| (TREM2 AND PSCA) | Pancreatic Ductal Carcinoma | 0.504423 | 0.456969 | 0.43 | 0.61 | 0.6 | 0.55 | 8E+09 |
| (CLDN18 AND NOT-MAL) | Pancreatic Ductal Carcinoma | 0.61824 | 0.659386 | 0.69 | 0.56 | 0.75 | 0.55 | 4.12E+09 |
| (CDH10 AND NRP1) | Prostate Cancer | | | 0.17 | 0.92 | 0 | 0 | 1.01E+09 |
| (KCNJ16 AND AXL) | Renal Cell Carcinoma | 0.725068 | 0.690992 | 0.67 | 0.79 | 0.9 | 0.75 | 5.58E+08 |
| (LRP2 AND AXL) | Renal Cell Carcinoma | 0.696216 | 0.81519 | 0.92 | 0.56 | 1 | 0.58 | 5.58E+08 |
| (LRP2 AND CA9) | Renal Cell Carcinoma | 0.57265 | 0.627341 | 0.92 | 0.56 | 0.67 | 0.5 | 7.68E+08 |
| (SLC16A4 AND AXL) | Renal Cell Carcinoma | 0.699178 | 0.703911 | 0.7 | 0.72 | 0.88 | 0.58 | 5.58E+08 |
| (SLC3A1 AND AXL) | Renal Cell Carcinoma | 0.75 | 0.75 | 0.8 | 0.82 | 0.75 | 0.75 | 5.58E+08 |
| (SLC3A1 AND CA9) | Renal Cell Carcinoma | 0.591549 | 0.783582 | 1 | 0.46 | 1 | 0.42 | 7.68E+08 |
| (TMEM27 AND CA9) | Renal Cell Carcinoma | 0.462366 | 0.442387 | 1 | 0.64 | 0.43 | 0.5 | 7.68E+08 |
| (AXL AND NOT-PDGFRA) | Renal Cell Carcinoma | 0.709859 | 0.703911 | 0.7 | 0.72 | 1 | 0.75 | 5.58E+08 |
| (CD70 AND NOT-ADRB2) | Renal Cell Carcinoma | 0.591549 | 0.783582 | 1 | 0.46 | 1 | 0.42 | 1.54E+08 |
| (CD99 AND B4GALNT1) | Soft Tissue Sarcoma | 0.634667 | 0.74375 | 0.81 | 0.67 | 0.84 | 0.51 | 2.58E+09 |
| (CDH11 AND B4GALNT1) | Soft Tissue Sarcoma | 0.545536 | 0.603755 | 0.94 | 0.84 | 0.65 | 0.47 | 1.01E+09 |
| (HTRA2 AND B4GALNT1) | Soft Tissue Sarcoma | 0.524571 | 0.526531 | 0.48 | 0.86 | 0.54 | 0.51 | 2.58E+09 |
| (NOT-ATP13A4 AND ROR1) | Soft Tissue Sarcoma | 0.604844 | 0.659365 | 0.79 | 0.49 | 0.67 | 0.62 | 4.92E+09 |
| (NOT-C1orf210 AND ERBB2) | Soft Tissue Sarcoma | 0.512621 | 0.534413 | 0.86 | 0.79 | 0.55 | 0.48 | 2.06E+09 |
| (NOT-C1orf210 AND ROR1) | Soft Tissue Sarcoma | 0.666667 | 0.625 | 0.79 | 0.83 | 0.6 | 0.75 | 4.92E+09 |
| (NOT-CDH1 AND ROR1) | Soft Tissue Sarcoma | 0.656541 | 0.61493 | 0.84 | 0.72 | 0.59 | 0.74 | 9.99E+08 |
| (NOT-ITGB6 AND ERBB2) | Soft Tissue Sarcoma | 0.511068 | 0.485609 | 0.65 | 0.82 | 0.47 | 0.56 | 2.06E+09 |
| (NOT-LSR AND ERBB2) | Soft Tissue Sarcoma | 0.482653 | 0.520925 | 0.84 | 0.68 | 0.55 | 0.43 | 2.06E+09 |
| (NOT-SCNN1A AND ERBB2) | Soft Tissue Sarcoma | 0.494949 | 0.497967 | 0.91 | 0.79 | 0.5 | 0.49 | 2.06E+09 |
| (NOT-SLC26A9 AND ROR1) | Soft Tissue Sarcoma | 0.616212 | 0.692308 | 0.83 | 0.49 | 0.72 | 0.6 | 4.92E+09 |
| (NOT-SLC2A12 AND ERBB2) | Soft Tissue Sarcoma | 0.484948 | 0.487967 | 0.69 | 0.72 | 0.49 | 0.48 | 2.06E+09 |
| (NOT-SLC6A14 AND ROR1) | Soft Tissue Sarcoma | 0.65313 | 0.63284 | 0.87 | 0.61 | 0.62 | 0.69 | 4.92E+09 |
| (NRCAM AND PROM1) | Glioma | 0.874743 | 0.865837 | 0.96 | 0.96 | 0.86 | 0.89 | 4.9E+09 |
| (NRCAM AND TSPAN11) | Glioma | 0.934332 | 0.949565 | 0.97 | 0.96 | 0.96 | 0.91 | 4.9E+09 |
| (NOT-ALDH1A1 AND IL3RA) | Acute Myeloid Leukemia | 0.750588 | 0.817949 | 0.96 | 0.89 | 0.87 | 0.66 | 2.16E+08 |
| (NOT-HEG1 AND IL3RA) | Acute Myeloid Leukemia | 0.789202 | 0.883516 | 0.97 | 0.89 | 0.96 | 0.67 | 3.56E+09 |
| (NOT-TGFBR3 AND IL3RA) | Acute Myeloid Leukemia | 0.747871 | 0.842442 | 0.95 | 0.92 | 0.92 | 0.63 | 3.56E+09 |
| (NOT-WLS AND IL3RA) | Acute Myeloid Leukemia | 0.76519 | 0.856232 | 0.95 | 0.96 | 0.93 | 0.65 | 3.56E+09 |
| (NOT-WLS AND PROM1) | Acute Myeloid Leukemia | 0.803951 | 0.847917 | 0.89 | 0.96 | 0.88 | 0.74 | 8.84E+09 |
| (NOT-LSR AND LRRC8E) | Bone Tumor | 0.806061 | 0.886667 | 0.95 | 0.7 | 1 | 0.8 | 5.16E+10 |
| (CLDN2 AND DLL4) | Gastric Cancer | 0.404938 | 0.40796 | 0.41 | 0.4 | 0.54 | 0.74 | 9.08E+09 |
| (CXCL9 AND DLL4) | Gastric Cancer | 0.468632 | 0.438189 | 0.42 | 0.53 | 0.64 | 0.42 | 4.28E+09 |
| (F2RL2 AND DLL4) | Gastric Cancer | 0.442637 | 0.49122 | 0.53 | 0.38 | 0.93 | 0.63 | 2.15E+09 |
| (MUC13 AND DKK1) | Gastric Cancer | 0.522162 | 0.611392 | 0.68 | 0.45 | 0.69 | 0.42 | 2.29E+10 |
| (VSIG1 AND DLL4) | Gastric Cancer | 0.630236 | 0.600592 | 0.58 | 0.7 | 0.69 | 0.58 | 5.46E+10 |
| (CRB1 AND IGFLR1) | Glioblastoma | 0.749867 | 0.743915 | 0.74 | 0.76 | 0.9 | 0.75 | 2.34E+10 |
| (CRB1 AND PROM1) | Glioma | 0.874743 | 0.883834 | 0.96 | 0.96 | 0.89 | 0.86 | 8.84E+09 |

FIG. 1 (cont.)

| Antigen Pair Logic | Exemplary Cancer Type | f1_min | f05_min | P_train | R_train | P_test | R_test | gid |
|---|---|---|---|---|---|---|---|---|
| (NLGN4X AND PROM1) | Glioma | 0.831377 | 0.79977 | 0.95 | 0.96 | 0.78 | 0.89 | 8.84E+09 |
| (SLC1A3 AND PROM1) | Glioma | 0.818902 | 0.801313 | 0.93 | 0.97 | 0.79 | 0.85 | 6.51E+09 |
| (AFP AND ALCAM) | Hepatocellular Carcinoma | 0.706849 | 0.759494 | 0.75 | 0.8 | 0.86 | 0.6 | 1.74E+08 |
| (AFP AND CNNM3) | Hepatocellular Carcinoma | 0.706849 | 0.745714 | 0.72 | 0.87 | 0.86 | 0.6 | 1.74E+08 |
| (AFP AND ERBB3) | Hepatocellular Carcinoma | 0.666667 | 0.692506 | 0.67 | 0.8 | 0.75 | 0.6 | 1.74E+08 |
| (AFP AND LRRC8D) | Hepatocellular Carcinoma | 0.752318 | 0.726343 | 0.71 | 0.8 | 0.88 | 0.7 | 1.74E+08 |
| (AFP AND SLC38A6) | Hepatocellular Carcinoma | 0.709437 | 0.697645 | 0.69 | 0.73 | 0.78 | 0.7 | 1.74E+08 |
| (SLC17A2 AND NOT-CLEC4M) | Hepatocellular Carcinoma | 0.855814 | 0.893204 | 0.92 | 0.8 | 1 | 0.8 | 1.02E+10 |
| (ADIPOR2 AND MAGEA1) | Melanoma | 0.529412 | 0.737705 | 1 | 0.46 | 1 | 0.36 | 4.1E+09 |
| (BCAP31 AND MAGEA1) | Melanoma | 0.529412 | 0.737705 | 1 | 0.37 | 1 | 0.36 | 4.1E+09 |
| (SLC5A6 AND MAGEA1) | Melanoma | 0.529412 | 0.709677 | 0.88 | 0.4 | 1 | 0.36 | 4.1E+09 |
| (NOT-HTR1E AND MAGEA1) | Melanoma | 0.529412 | 0.737705 | 0.94 | 0.43 | 1 | 0.36 | 3.35E+09 |
| (NOT-NPFFR1 AND MAGEA1) | Melanoma | 0.529412 | 0.737705 | 1 | 0.37 | 1 | 0.36 | 4.1E+09 |
| (PMEL AND NOT-ATP1A2) | Melanoma | 0.941799 | 0.975877 | 1 | 0.89 | 1 | 0.91 | 4.77E+08 |
| (PMEL AND NOT-SCN3B) | Melanoma | 0.941799 | 0.975877 | 1 | 0.89 | 1 | 0.91 | 6.49E+09 |
| (PMEL AND NOT-STAB2) | Melanoma | 0.941799 | 0.975877 | 1 | 0.89 | 1 | 0.91 | 6.49E+09 |
| (PMEL AND NOT-TMEM100) | Melanoma | 0.941799 | 0.975877 | 1 | 0.89 | 1 | 0.91 | 6.49E+09 |
| (L1CAM AND DIABLO) | Neuroblastoma | 0.964352 | 0.957739 | 0.99 | 0.94 | 0.95 | 0.99 | 3.9E+09 |
| (L1CAM AND NOT-NTRK2) | Neuroblastoma | 0.93734 | 0.967382 | 0.99 | 0.89 | 0.98 | 0.92 | 3.9E+09 |
| (CD80 AND NOT-GPM6A) | Non Small Cell Lung Cancer | 0.469792 | 0.51484 | 0.61 | 0.4 | 0.55 | 0.41 | 9.41E+08 |
| (CD86 AND NOT-CD33) | Non Small Cell Lung Cancer | 0.436559 | 0.512626 | 0.58 | 0.35 | 0.68 | 0.51 | 9.42E+08 |
| (NOT-CD36 AND CD86) | Non Small Cell Lung Cancer | 0.443596 | 0.45907 | 0.47 | 0.42 | 0.68 | 0.62 | 9.42E+08 |
| (NOT-GPBAR1 AND CD86) | Non Small Cell Lung Cancer | 0.444494 | 0.45367 | 0.46 | 0.43 | 0.72 | 0.78 | 9.42E+08 |
| (NOT-P2RX1 AND CD86) | Non Small Cell Lung Cancer | 0.442 | 0.480435 | 0.51 | 0.39 | 0.51 | 0.68 | 9.42E+08 |
| (NOT-SEZ6 AND CD80) | Non Small Cell Lung Cancer | 0.464946 | 0.453871 | 0.42 | 0.67 | 0.47 | 0.46 | 9.41E+08 |
| (NOT-SLC13A4 AND CD80) | Non Small Cell Lung Cancer | 0.466667 | 0.48251 | 0.47 | 0.54 | 0.56 | 0.4 | 9.41E+08 |
| (NOT-SLC6A4 AND CD80) | Non Small Cell Lung Cancer | 0.4928 | 0.459701 | 0.44 | 0.56 | 0.49 | 0.55 | 9.41E+08 |
| (LRRTM1 AND SLC28A3) | Ovarian Cancer | 0.591549 | 0.783582 | 0.82 | 0.79 | 1 | 0.42 | 6.41E+10 |
| (LRRTM1 AND VTCN1) | Ovarian Cancer | 0.496241 | 0.711207 | 0.83 | 0.74 | 1 | 0.33 | 7.97E+10 |
| (PIRT AND VTCN1) | Ovarian Cancer | 0.290598 | 0.505952 | 0.68 | 0.68 | 1 | 0.17 | 7.97E+10 |
| (SSX1 AND VTCN1) | Ovarian Cancer | 0.290598 | 0.505952 | 0.78 | 0.58 | 1 | 0.17 | 6.76E+09 |
| (CLCNKB AND NOT-SLC22A2) | Ovarian Cancer | 0.1088 | 0.089474 | 0.18 | 0.62 | 0.08 | 0.17 | 1.19E+09 |
| (LRRTM1 AND NOT-SCN4B) | Ovarian Cancer | 0.591549 | 0.783582 | 0.91 | 0.77 | 1 | 0.42 | 6.33E+09 |
| (NOX4 AND CEACAM6) | Pancreatic Ductal Carcinoma | 0.580588 | 0.753435 | 0.94 | 0.42 | 1 | 0.55 | 4.68E+09 |
| (ATP9A AND NRP1) | Prostate Cancer | | | 0.2 | 0.83 | 0 | 0 | 8.83E+09 |
| (CDH7 AND NRP1) | Prostate Cancer | 0.183784 | 0.175258 | 0.29 | 0.58 | 0.17 | 0.2 | 1.01E+09 |
| (TSPAN1 AND NRP1) | Prostate Cancer | | | 1 | 0.67 | 0 | 0 | 8.83E+09 |
| (FOLH1 AND NOT-SEMA5A) | Prostate Cancer | 0.67 | 0.67 | 0.67 | 0.67 | 0.8 | 0.8 | 2.35E+09 |
| (NRP1 AND NOT-RAMP3) | Prostate Cancer | | | 0.16 | 0.67 | 0 | 0 | 8.83E+09 |
| (TRPM8 AND NOT-EPHB1) | Prostate Cancer | 0.8 | 0.789474 | 0.75 | 1 | 0.8 | 0.8 | 2.05E+09 |
| (CLDN2 AND PCDHB10) | Renal Cell Carcinoma | 0.668088 | 0.725719 | 0.77 | 0.59 | 0.88 | 0.58 | 9.08E+09 |
| (ENPEP AND ROR2) | Renal Cell Carcinoma | 0.4838 | 0.542377 | 0.59 | 0.41 | 1 | 0.33 | 2.03E+09 |
| (ENPP3 AND ROR2) | Renal Cell Carcinoma | 0.496241 | 0.579675 | 0.62 | 0.46 | 1 | 0.33 | 4.92E+09 |
| (EPHA7 AND SLCO4C1) | Renal Cell Carcinoma | 0.668088 | 0.725719 | 0.77 | 0.59 | 1 | 0.58 | 2.05E+09 |
| (MAGT1 AND ROR2) | Renal Cell Carcinoma | 0.272727 | 0.288462 | 0.42 | 0.33 | 0.3 | 0.25 | 4.92E+09 |
| (SLC3A1 AND ROR2) | Renal Cell Carcinoma | 0.545455 | 0.520879 | 0.48 | 0.79 | 0.6 | 0.5 | 4.92E+09 |
| (NOT-GPM6B AND ROR2) | Renal Cell Carcinoma | 0.225556 | 0.165041 | 0.14 | 0.64 | 0.14 | 0.58 | 2.82E+09 |
| (SLC22A2 AND NOT-CLCNKB) | Renal Cell Carcinoma | 0.734177 | 0.873494 | 1 | 0.69 | 1 | 0.58 | 1.19E+09 |
| (SLC22A2 AND NOT-KCNJ1) | Renal Cell Carcinoma | 0.734177 | 0.873494 | 1 | 0.69 | 1 | 0.58 | 3.76E+09 |
| (LINGO1 AND NOT-NALCN) | Soft Tissue Sarcoma | 0.541212 | 0.726016 | 0.98 | 0.82 | 0.94 | 0.38 | 8.49E+10 |
| (THY1 AND NOT-NDRG4) | Soft Tissue Sarcoma | 0.70875 | 0.766216 | 0.92 | 0.58 | 0.81 | 0.63 | 7.07E+09 |

FIG. 2

| Antigen | GeneID | Accession No. | SEQ ID NO. | Gene Full Name |
|---|---|---|---|---|
| ABCC6 | 368 | NP_001072996.1 | 1 | Multidrug resistance-associated protein 6 |
| ABCC6 | 368 | NP_001162.4 | 2 | Multidrug resistance-associated protein 6 |
| ACSL6 | 23305 | NP_001009185.1 | 3 | Long-chain-fatty-acid--CoA ligase 6 |
| ACSL6 | 23305 | NP_001192176.1 | 4 | Long-chain-fatty-acid--CoA ligase 6 |
| ACSL6 | 23305 | NP_001192177.1 | 5 | Long-chain-fatty-acid--CoA ligase 6 |
| ACSL6 | 23305 | NP_001192179.1 | 6 | Long-chain-fatty-acid--CoA ligase 6 |
| ACSL6 | 23305 | NP_001192180.1 | 7 | Long-chain-fatty-acid--CoA ligase 6 |
| ACSL6 | 23305 | NP_056071.2 | 8 | Long-chain-fatty-acid--CoA ligase 6 |
| ADAM12 | 8038 | NP_001275903.1 | 9 | Disintegrin and metalloproteinase domain-containing protein 12 |
| ADAM12 | 8038 | NP_001275904.1 | 10 | Disintegrin and metalloproteinase domain-containing protein 12 |
| ADAM12 | 8038 | NP_003465.3 | 11 | Disintegrin and metalloproteinase domain-containing protein 12 |
| ADAM12 | 8038 | NP_067673.2 | 12 | Disintegrin and metalloproteinase domain-containing protein 12 |
| ADAM17 | 6868 | NP_003174.3 | 13 | Disintegrin and metalloproteinase domain-containing protein 17 |
| ADAM29 | 11086 | NP_001124175.1 | 14 | Disintegrin and metalloproteinase domain-containing protein 29 |
| ADAM29 | 11086 | NP_001124176.1 | 15 | Disintegrin and metalloproteinase domain-containing protein 29 |
| ADAM29 | 11086 | NP_001124177.1 | 16 | Disintegrin and metalloproteinase domain-containing protein 29 |
| ADAM29 | 11086 | NP_001265054.1 | 17 | Disintegrin and metalloproteinase domain-containing protein 29 |
| ADAM29 | 11086 | NP_001265055.1 | 18 | Disintegrin and metalloproteinase domain-containing protein 29 |
| ADAM29 | 11086 | NP_001265056.1 | 19 | Disintegrin and metalloproteinase domain-containing protein 29 |
| ADAM29 | 11086 | NP_055084.3 | 20 | Disintegrin and metalloproteinase domain-containing protein 29 |
| ADCY4 | 196883 | NP_001185497.1 | 21 | Adenylate cyclase type 4 |
| ADCY4 | 196883 | NP_001185521.1 | 22 | Adenylate cyclase type 4 |
| ADCY4 | 196883 | NP_640340.2 | 23 | Adenylate cyclase type 4 |
| ADIPOR2 | 79602 | NP_078827.2 | 24 | Adiponectin receptor protein 2 |
| ADRB2 | 154 | NP_000015.1 | 25 | Beta-2 adrenergic receptor |
| AFP | 174 | NP_001125.1 | 26 | Alpha-fetoprotein |
| ALCAM | 214 | NP_001230209.1 | 27 | CD166 antigen |
| ALCAM | 214 | NP_001230212.1 | 28 | CD166 antigen |
| ALCAM | 214 | NP_001618.2 | 29 | CD166 antigen |
| ALDH1A1 | 216 | NP_000680.2 | 30 | Retinal dehydrogenase 1 |
| AMIGO2 | 347902 | NP_001137140.1 | 31 | Amphoterin-induced protein 2 |
| AMIGO2 | 347902 | NP_862830.1 | 32 | Amphoterin-induced protein 2 |
| AQP4 | 361 | NP_001641.1 | 33 | Aquaporin-4 |
| AQP4 | 361 | NP_004019.1 | 34 | Aquaporin-4 |
| ATP13A4 | 84239 | NP_115655.2 | 35 | Probable cation-transporting ATPase 13A4 |
| ATP1A2 | 477 | NP_000693.1 | 36 | Sodium/potassium-transporting ATPase subunit alpha-2 |
| ATP9A | 10079 | NP_006036.1 | 37 | Probable phospholipid-transporting ATPase IIA |
| AXL | 558 | NP_001690.2 | 38 | Tyrosine-protein kinase receptor UFO |
| AXL | 558 | NP_068713.2 | 39 | Tyrosine-protein kinase receptor UFO |
| B4GALNT1 | 2583 | NP_001263397.1 | 40 | Beta-1,4 N-acetylgalactosaminyltransferase 1 |
| B4GALNT1 | 2583 | NP_001263398.1 | 41 | Beta-1,4 N-acetylgalactosaminyltransferase 1 |
| B4GALNT1 | 2583 | NP_001469.1 | 42 | Beta-1,4 N-acetylgalactosaminyltransferase 1 |
| BAMBI | 25805 | NP_036474.1 | 43 | BMP and activin membrane-bound inhibitor homolog |
| BCAN | 63827 | NP_068767.3 | 44 | Brevican core protein |
| BCAN | 63827 | NP_940819.1 | 45 | Brevican core protein |
| BCAP31 | 10134 | NP_001132913.1 | 46 | B-cell receptor-associated protein 31 |
| BCAP31 | 10134 | NP_001132929.1 | 47 | B-cell receptor-associated protein 31 |
| BCAP31 | 10134 | NP_001243376.1 | 48 | B-cell receptor-associated protein 31 |
| BCAP31 | 10134 | NP_005736.3 | 49 | B-cell receptor-associated protein 31 |
| BEST3 | 144453 | NP_001269542.1 | 50 | Bestrophin-3 |
| BEST3 | 144453 | NP_001269543.1 | 51 | Bestrophin-3 |
| BEST3 | 144453 | NP_001269544.1 | 52 | Bestrophin-3 |
| BEST3 | 144453 | NP_001269545.1 | 53 | Bestrophin-3 |
| BEST3 | 144453 | NP_116124.2 | 54 | Bestrophin-3 |
| BEST3 | 144453 | NP_689652.2 | 55 | Bestrophin-3 |
| BFAR | 51283 | NP_057645.1 | 56 | Bifunctional apoptosis regulator |
| BIRC5 | 332 | NP_001012270.1 | 57 | Baculoviral IAP repeat-containing protein 5 |
| BIRC5 | 332 | NP_001012271.1 | 58 | Baculoviral IAP repeat-containing protein 5 |
| BIRC5 | 332 | NP_001159.2 | 59 | Baculoviral IAP repeat-containing protein 5 |
| C11orf24 | 53838 | NP_001287842.1 | 60 | Uncharacterized protein C11orf24 |
| C11orf24 | 53838 | NP_071733.1 | 61 | Uncharacterized protein C11orf24 |
| C1orf210 | 149466 | NP_001158301.1 | 62 | Type III endosome membrane protein TEMP |
| C1orf210 | 149466 | NP_872323.1 | 63 | Type III endosome membrane protein TEMP |
| C1QTNF1 | 114897 | NP_112230.1 | 64 | Complement C1q tumor necrosis factor-related protein 1 |
| C1QTNF1 | 114897 | NP_699203.1 | 65 | Complement C1q tumor necrosis factor-related protein 1 |
| C1QTNF1 | 114897 | NP_940995.1 | 66 | Complement C1q tumor necrosis factor-related protein 1 |
| C1QTNF1 | 114897 | NP_940996.1 | 67 | Complement C1q tumor necrosis factor-related protein 1 |
| CA9 | 768 | NP_001207.2 | 68 | Carbonic anhydrase 9 |
| CADM1 | 23705 | NP_001091987.1 | 69 | Cell adhesion molecule 1 |
| CADM1 | 23705 | NP_001287972.1 | 70 | Cell adhesion molecule 1 |

FIG. 2 (cont.)

| Antigen | GeneID | Accession No. | SEQ ID NO. | Gene Full Name |
|---|---|---|---|---|
| CADM1 | 23705 | NP_001287973.1 | 71 | Cell adhesion molecule 1 |
| CADM1 | 23705 | NP_001287974.1 | 72 | Cell adhesion molecule 1 |
| CADM1 | 23705 | NP_055148.3 | 73 | Cell adhesion molecule 1 |
| CADM3 | 57863 | NP_001120645.1 | 74 | Cell adhesion molecule 3 |
| CADM3 | 57863 | NP_001333439.1 | 75 | Cell adhesion molecule 3 |
| CADM3 | 57863 | NP_067012.1 | 76 | Cell adhesion molecule 3 |
| CCR5 | 1234 | NP_000570.1 | 77 | C-C chemokine receptor type 5 |
| CCR5 | 1234 | NP_001093638.1 | 78 | C-C chemokine receptor type 5 |
| CD101 | 9398 | NP_001243035.1 | 79 | Immunoglobulin superfamily member 2 |
| CD101 | 9398 | NP_001243038.1 | 80 | Immunoglobulin superfamily member 2 |
| CD101 | 9398 | NP_004249.2 | 81 | Immunoglobulin superfamily member 2 |
| CD274 | 29126 | NP_001254635.1 | 82 | Programmed cell death 1 ligand 1 |
| CD274 | 29126 | NP_054862.1 | 83 | Programmed cell death 1 ligand 1 |
| CD33 | 945 | NP_001076087.1 | 84 | Myeloid cell surface antigen CD33 |
| CD33 | 945 | NP_001171079.1 | 85 | Myeloid cell surface antigen CD33 |
| CD33 | 945 | NP_001763.3 | 86 | Myeloid cell surface antigen CD33 |
| CD36 | 948 | NP_000063.2 | 87 | Platelet glycoprotein 4 |
| CD36 | 948 | NP_001001547.1 | 88 | Platelet glycoprotein 4 |
| CD36 | 948 | NP_001001548.1 | 89 | Platelet glycoprotein 4 |
| CD36 | 948 | NP_001120915.1 | 90 | Platelet glycoprotein 4 |
| CD36 | 948 | NP_001120916.1 | 91 | Platelet glycoprotein 4 |
| CD36 | 948 | NP_001276837.1 | 92 | Platelet glycoprotein 4 |
| CD36 | 948 | NP_001276838.1 | 93 | Platelet glycoprotein 4 |
| CD36 | 948 | NP_001276840.1 | 94 | Platelet glycoprotein 4 |
| CD70 | 970 | NP_001243.1 | 95 | CD70 antigen |
| CD70 | 970 | NP_001317261.1 | 96 | CD70 antigen |
| CD80 | 941 | NP_005182.1 | 97 | T-lymphocyte activation antigen CD80 |
| CD84 | 8832 | NP_001171808.1 | 98 | SLAM family member 5 |
| CD84 | 8832 | NP_001171810.1 | 99 | SLAM family member 5 |
| CD84 | 8832 | NP_001171811.1 | 100 | SLAM family member 5 |
| CD84 | 8832 | NP_001317671.1 | 101 | SLAM family member 5 |
| CD84 | 8832 | NP_003865.1 | 102 | SLAM family member 5 |
| CD86 | 942 | NP_001193853.1 | 103 | T-lymphocyte activation antigen CD86 |
| CD86 | 942 | NP_001193854.1 | 104 | T-lymphocyte activation antigen CD86 |
| CD86 | 942 | NP_008820.3 | 105 | T-lymphocyte activation antigen CD86 |
| CD86 | 942 | NP_787058.4 | 106 | T-lymphocyte activation antigen CD86 |
| CD86 | 942 | NP_795711.1 | 107 | T-lymphocyte activation antigen CD86 |
| CD99 | 4267 | NP_001116370.1 | 108 | CD99 antigen |
| CD99 | 4267 | NP_001308296.1 | 109 | CD99 antigen |
| CD99 | 4267 | NP_001308297.1 | 110 | CD99 antigen |
| CD99 | 4267 | NP_001308298.1 | 111 | CD99 antigen |
| CD99 | 4267 | NP_002405.1 | 112 | CD99 antigen |
| CDH1 | 999 | NP_001304113.1 | 113 | Cadherin-1 |
| CDH1 | 999 | NP_001304114.1 | 114 | Cadherin-1 |
| CDH1 | 999 | NP_001304115.1 | 115 | Cadherin-1 |
| CDH1 | 999 | NP_004351.1 | 116 | Cadherin-1 |
| CDH10 | 1008 | NP_006718.2 | 117 | Cadherin-10 |
| CDH11 | 1009 | NP_001295321.1 | 118 | Cadherin-11 |
| CDH11 | 1009 | NP_001788.2 | 119 | Cadherin-11 |
| CDH6 | 1004 | NP_004923.1 | 120 | Cadherin-6 |
| CDH7 | 1005 | NP_001304143.1 | 121 | Cadherin-7 |
| CDH7 | 1005 | NP_004352.2 | 122 | Cadherin-7 |
| CDH7 | 1005 | NP_387450.1 | 123 | Cadherin-7 |
| CEACAM5 | 1048 | NP_001278413.1 | 124 | Carcinoembryonic antigen-related cell adhesion molecule 5 |
| CEACAM5 | 1048 | NP_001295327.1 | 125 | Carcinoembryonic antigen-related cell adhesion molecule 5 |
| CEACAM5 | 1048 | NP_004354.3 | 126 | Carcinoembryonic antigen-related cell adhesion molecule 5 |
| CEACAM6 | 4680 | NP_002474.4 | 127 | Carcinoembryonic antigen-related cell adhesion molecule 6 |
| CLCNKB | 1188 | NP_000076.2 | 128 | Chloride channel protein ClC-Kb |
| CLCNKB | 1188 | NP_001159417.2 | 129 | Chloride channel protein ClC-Kb |
| CLDN15 | 24146 | NP_001172009.1 | 130 | Claudin-15 |
| CLDN15 | 24146 | NP_055158.1 | 131 | Claudin-15 |
| CLDN18 | 51208 | NP_001002026.1 | 132 | Claudin-18 |
| CLDN18 | 51208 | NP_057453.1 | 133 | Claudin-18 |
| CLDN2 | 9075 | NP_001164563.1 | 134 | Claudin-2 |
| CLDN2 | 9075 | NP_001164566.1 | 135 | Claudin-2 |
| CLDN2 | 9075 | NP_065117.1 | 136 | Claudin-2 |
| CLDN3 | 1365 | NP_001297.1 | 137 | Claudin-3 |
| CLEC4M | 10332 | NP_001138377.1 | 138 | C-type lectin domain family 4 member M |
| CLEC4M | 10332 | NP_001138378.1 | 139 | C-type lectin domain family 4 member M |

FIG. 2 (cont.)

| Antigen | GeneID | Accession No. | SEQ ID NO. | Gene Full Name |
|---|---|---|---|---|
| CLEC4M | 10332 | NP_001138379.1 | 140 | C-type lectin domain family 4 member M |
| CLEC4M | 10332 | NP_001138380.1 | 141 | C-type lectin domain family 4 member M |
| CLEC4M | 10332 | NP_001138381.1 | 142 | C-type lectin domain family 4 member M |
| CLEC4M | 10332 | NP_001138382.1 | 143 | C-type lectin domain family 4 member M |
| CLEC4M | 10332 | NP_001138383.1 | 144 | C-type lectin domain family 4 member M |
| CLEC4M | 10332 | NP_055072.3 | 145 | C-type lectin domain family 4 member M |
| CNNM3 | 26505 | NP_060093.3 | 146 | Metal transporter CNNM3 |
| CNNM3 | 26505 | NP_951060.1 | 147 | Metal transporter CNNM3 |
| CRB1 | 23418 | NP_001180569.1 | 148 | Protein crumbs homolog 1 |
| CRB1 | 23418 | NP_001244894.1 | 149 | Protein crumbs homolog 1 |
| CRB1 | 23418 | NP_001244895.1 | 150 | Protein crumbs homolog 1 |
| CRB1 | 23418 | NP_957705.1 | 151 | Protein crumbs homolog 1 |
| CSF3R | 1441 | NP_000751.1 | 152 | Granulocyte colony-stimulating factor receptor |
| CSF3R | 1441 | NP_724781.1 | 153 | Granulocyte colony-stimulating factor receptor |
| CSF3R | 1441 | NP_758519.1 | 154 | Granulocyte colony-stimulating factor receptor |
| CXCL9 | 4283 | NP_002407.1 | 155 | C-X-C motif chemokine 9 |
| CYP4F12 | 66002 | NP_076433.3 | 156 | Cytochrome P450 4F12 |
| DIABLO | 56616 | NP_001265231.1 | 157 | Diablo homolog, mitochondrial |
| DIABLO | 56616 | NP_001265232.1 | 158 | Diablo homolog, mitochondrial |
| DIABLO | 56616 | NP_001265233.1 | 159 | Diablo homolog, mitochondrial |
| DIABLO | 56616 | NP_001265271.1 | 160 | Diablo homolog, mitochondrial |
| DIABLO | 56616 | NP_063940.1 | 161 | Diablo homolog, mitochondrial |
| DIABLO | 56616 | NP_620308.1 | 162 | Diablo homolog, mitochondrial |
| DKK1 | 22943 | NP_036374.1 | 163 | Dickkopf-related protein 1 |
| DLL3 | 10683 | NP_058637.1 | 164 | Delta-like protein 3 |
| DLL3 | 10683 | NP_982353.1 | 165 | Delta-like protein 3 |
| DLL4 | 54567 | NP_061947.1 | 166 | Delta-like protein 4 |
| EGFR | 1956 | NP_005219.2 | 167 | Epidermal growth factor receptor |
| EGFR | 1956 | NP_958439.1 | 168 | Epidermal growth factor receptor |
| EGFR | 1956 | NP_958440.1 | 169 | Epidermal growth factor receptor |
| EGFR | 1956 | NP_958441.1 | 170 | Epidermal growth factor receptor |
| ENPEP | 2028 | NP_001968.3 | 171 | Glutamyl aminopeptidase |
| ENPP3 | 5169 | NP_005012.2 | 172 | Ectonucleotide pyrophosphatase/phosphodiesterase family member 3 |
| EPCAM | 4072 | NP_002345.2 | 173 | Epithelial cell adhesion molecule |
| EPHA2 | 1969 | NP_004422.2 | 174 | Ephrin type-A receptor 2 |
| EPHA7 | 2045 | NP_001275558.1 | 175 | Ephrin type-A receptor 7 |
| EPHA7 | 2045 | NP_001275559.1 | 176 | Ephrin type-A receptor 7 |
| EPHA7 | 2045 | NP_004431.1 | 177 | Ephrin type-A receptor 7 |
| EPHB1 | 2047 | NP_004432.1 | 178 | Ephrin type-B receptor 1 |
| ERBB2 | 2064 | NP_001005862.1 | 179 | Receptor tyrosine-protein kinase erbB-2 |
| ERBB2 | 2064 | NP_001276865.1 | 180 | Receptor tyrosine-protein kinase erbB-2 |
| ERBB2 | 2064 | NP_001276867.1 | 181 | Receptor tyrosine-protein kinase erbB-2 |
| ERBB2 | 2064 | NP_004439.2 | 182 | Receptor tyrosine-protein kinase erbB-2 |
| ERBB3 | 2065 | NP_001005915.1 | 183 | Receptor tyrosine-protein kinase erbB-3 |
| ERBB3 | 2065 | NP_001973.2 | 184 | Receptor tyrosine-protein kinase erbB-3 |
| F2R | 2149 | NP_001298242.1 | 185 | Proteinase-activated receptor 1 |
| F2R | 2149 | NP_001983.2 | 186 | Proteinase-activated receptor 1 |
| F2RL2 | 2151 | NP_001243495.1 | 187 | Proteinase-activated receptor 3 |
| F2RL2 | 2151 | NP_004092.1 | 188 | Proteinase-activated receptor 3 |
| FAP | 2191 | NP_001278736.1 | 189 | Prolyl endopeptidase FAP |
| FAP | 2191 | NP_004451.2 | 190 | Prolyl endopeptidase FAP |
| FCRL5 | 83416 | NP_001182317.1 | 191 | Fc receptor-like protein 5 |
| FCRL5 | 83416 | NP_112571.2 | 192 | Fc receptor-like protein 5 |
| FOLH1 | 2346 | NP_001014986.1 | 193 | Glutamate carboxypeptidase 2 |
| FOLH1 | 2346 | NP_001180400.1 | 194 | Glutamate carboxypeptidase 2 |
| FOLH1 | 2346 | NP_001180401.1 | 195 | Glutamate carboxypeptidase 2 |
| FOLH1 | 2346 | NP_001180402.1 | 196 | Glutamate carboxypeptidase 2 |
| FOLH1 | 2346 | NP_004467.1 | 197 | Glutamate carboxypeptidase 2 |
| FOLR1 | 2348 | NP_000793.1 | 198 | Folate receptor alpha |
| FOLR1 | 2348 | NP_057936.1 | 199 | Folate receptor alpha |
| FOLR1 | 2348 | NP_057937.1 | 200 | Folate receptor alpha |
| FOLR1 | 2348 | NP_057941.1 | 201 | Folate receptor alpha |
| FXYD3 | 5349 | NP_001129479.1 | 202 | FXYD domain-containing ion transport regulator 3 |
| FXYD3 | 5349 | NP_001129480.1 | 203 | FXYD domain-containing ion transport regulator 3 |
| FXYD3 | 5349 | NP_001129481.1 | 204 | FXYD domain-containing ion transport regulator 3 |
| FXYD3 | 5349 | NP_001129482.1 | 205 | FXYD domain-containing ion transport regulator 3 |
| FXYD3 | 5349 | NP_001129483.1 | 206 | FXYD domain-containing ion transport regulator 3 |
| FXYD3 | 5349 | NP_001129484.1 | 207 | FXYD domain-containing ion transport regulator 3 |
| FXYD3 | 5349 | NP_005962.1 | 208 | FXYD domain-containing ion transport regulator 3 |

FIG. 2 (cont.)

| Antigen | GeneID | Accession No. | SEQ ID NO: | Gene Full Name |
|---|---|---|---|---|
| FXYD3 | 5349 | NP_068710.1 | 209 | FXYD domain-containing ion transport regulator 3 |
| GP2 | 2813 | NP_001007241.2 | 210 | Pancreatic secretory granule membrane major glycoprotein GP2 |
| GP2 | 2813 | NP_001493.2 | 211 | Pancreatic secretory granule membrane major glycoprotein GP2 |
| GPBAR1 | 151306 | NP_001070659.1 | 212 | G-protein coupled bile acid receptor 1 |
| GPBAR1 | 151306 | NP_001070662.1 | 213 | G-protein coupled bile acid receptor 1 |
| GPBAR1 | 151306 | NP_001308879.1 | 214 | G-protein coupled bile acid receptor 1 |
| GPBAR1 | 151306 | NP_733800.1 | 215 | G-protein coupled bile acid receptor 1 |
| GPC3 | 2719 | NP_001158089.1 | 216 | Glypican-3 |
| GPC3 | 2719 | NP_001158091.1 | 217 | Glypican-3 |
| GPC3 | 2719 | NP_004475.1 | 218 | Glypican-3 |
| GPM6A | 2823 | NP_001248377.1 | 219 | Neuronal membrane glycoprotein M6-a |
| GPM6A | 2823 | NP_005268.1 | 220 | Neuronal membrane glycoprotein M6-a |
| GPM6A | 2823 | NP_963885.1 | 221 | Neuronal membrane glycoprotein M6-a |
| GPM6A | 2823 | NP_963886.1 | 222 | Neuronal membrane glycoprotein M6-a |
| GPM6B | 2824 | NP_001001994.1 | 223 | Neuronal membrane glycoprotein M6-b |
| GPM6B | 2824 | NP_001001995.1 | 224 | Neuronal membrane glycoprotein M6-b |
| GPM6B | 2824 | NP_001001996.1 | 225 | Neuronal membrane glycoprotein M6-b |
| GPM6B | 2824 | NP_005269.1 | 226 | Neuronal membrane glycoprotein M6-b |
| GPR1 | 2825 | NP_001091669.1 | 227 | G-protein coupled receptor 1 |
| GPR1 | 2825 | NP_001248381.1 | 228 | G-protein coupled receptor 1 |
| GPR1 | 2825 | NP_001248382.1 | 229 | G-protein coupled receptor 1 |
| GPR1 | 2825 | NP_001248383.1 | 230 | G-protein coupled receptor 1 |
| GPR1 | 2825 | NP_001248384.1 | 231 | G-protein coupled receptor 1 |
| GPR1 | 2825 | NP_005270.2 | 232 | G-protein coupled receptor 1 |
| GPR19 | 2842 | NP_006134.1 | 233 | Probable G-protein coupled receptor 19 |
| GPR88 | 54112 | NP_071332.2 | 234 | Probable G-protein coupled receptor 88 |
| GRIK5 | 2901 | NP_001287959.1 | 235 | Glutamate receptor ionotropic, kainate 5 |
| GRIK5 | 2901 | NP_002079.3 | 236 | Glutamate receptor ionotropic, kainate 5 |
| HEG1 | 57493 | NP_065784.1 | 237 | Protein HEG homolog 1 |
| HTR1E | 3354 | NP_000856.1 | 238 | 5-hydroxytryptamine receptor 1E |
| HTRA2 | 27429 | NP_001308656.1 | 239 | Serine protease HTRA2, mitochondrial |
| HTRA2 | 27429 | NP_037379.1 | 240 | Serine protease HTRA2, mitochondrial |
| HTRA2 | 27429 | NP_659540.1 | 241 | Serine protease HTRA2, mitochondrial |
| IGFLR1 | 79713 | NP_001332933.1 | 242 | IGF-like family receptor 1 |
| IGFLR1 | 79713 | NP_001332934.1 | 243 | IGF-like family receptor 1 |
| IGFLR1 | 79713 | NP_078936.1 | 244 | IGF-like family receptor 1 |
| IL13RA2 | 3598 | NP_000631.1 | 245 | Interleukin-13 receptor subunit alpha-2 |
| IL2RA | 3559 | NP_000408.1 | 246 | Interleukin-2 receptor subunit alpha |
| IL2RA | 3559 | NP_001295171.1 | 247 | Interleukin-2 receptor subunit alpha |
| IL2RA | 3559 | NP_001295172.1 | 248 | Interleukin-2 receptor subunit alpha |
| IL3RA | 3563 | NP_001254642.1 | 249 | Interleukin-3 receptor subunit alpha |
| IL3RA | 3563 | NP_002174.1 | 250 | Interleukin-3 receptor subunit alpha |
| ITGB6 | 3694 | NP_000879.2 | 251 | Integrin beta-6 |
| ITGB6 | 3694 | NP_001269282.1 | 252 | Integrin beta-6 |
| ITGB6 | 3694 | NP_001269284.1 | 253 | Integrin beta-6 |
| ITGB6 | 3694 | NP_001269317.1 | 254 | Integrin beta-6 |
| ITGB8 | 3696 | NP_002205.1 | 255 | Integrin beta-8 |
| KCNA6 | 3742 | NP_002226.1 | 256 | Potassium voltage-gated channel subfamily A member 6 |
| KCNB1 | 3745 | NP_004966.1 | 257 | Potassium voltage-gated channel subfamily B member 1 |
| KCNE4 | 23704 | NP_542402.3 | 258 | Potassium voltage-gated channel subfamily E member 4 |
| KCNJ1 | 3758 | NP_000211.1 | 259 | ATP-sensitive inward rectifier potassium channel 1 |
| KCNJ1 | 3758 | NP_722448.1 | 260 | ATP-sensitive inward rectifier potassium channel 1 |
| KCNJ1 | 3758 | NP_722449.3 | 261 | ATP-sensitive inward rectifier potassium channel 1 |
| KCNJ1 | 3758 | NP_722450.1 | 262 | ATP-sensitive inward rectifier potassium channel 1 |
| KCNJ1 | 3758 | NP_722451.1 | 263 | ATP-sensitive inward rectifier potassium channel 1 |
| KCNJ16 | 3773 | NP_001257351.1 | 264 | Inward rectifier potassium channel 16 |
| KCNJ16 | 3773 | NP_001278551.1 | 265 | Inward rectifier potassium channel 16 |
| KCNJ16 | 3773 | NP_001278552.1 | 266 | Inward rectifier potassium channel 16 |
| KCNJ16 | 3773 | NP_001278553.1 | 267 | Inward rectifier potassium channel 16 |
| KCNJ16 | 3773 | NP_001278554.1 | 268 | Inward rectifier potassium channel 16 |
| KCNJ16 | 3773 | NP_061128.2 | 269 | Inward rectifier potassium channel 16 |
| KCNJ16 | 3773 | NP_733937.2 | 270 | Inward rectifier potassium channel 16 |
| KCNJ16 | 3773 | NP_733938.2 | 271 | Inward rectifier potassium channel 16 |
| KCNJ5 | 3762 | NP_000881.3 | 272 | G protein-activated inward rectifier potassium channel 4 |
| KCNK15 | 60598 | NP_071753.2 | 273 | Potassium channel subfamily K member 15 |
| KDR | 3791 | NP_002244.1 | 274 | Vascular endothelial growth factor receptor 2 |
| KISS1R | 84634 | NP_115940.2 | 275 | KiSS-1 receptor |
| L1CAM | 3897 | NP_000416.1 | 276 | Neural cell adhesion molecule L1 |
| L1CAM | 3897 | NP_001137435.1 | 277 | Neural cell adhesion molecule L1 |

FIG. 2 (cont.)

| Antigen | GeneID | Accession No. | SEQ ID NO: | Gene Full Name |
|---|---|---|---|---|
| L1CAM | 3897 | NP_001265045.1 | 278 | Neural cell adhesion molecule L1 |
| L1CAM | 3897 | NP_076493.1 | 279 | Neural cell adhesion molecule L1 |
| LIFR | 3977 | NP_001121143.1 | 280 | Leukemia inhibitory factor receptor |
| LIFR | 3977 | NP_002301.1 | 281 | Leukemia inhibitory factor receptor |
| LINGO1 | 84894 | NP_001288115.1 | 282 | Leucine-rich repeat and immunoglobulin-like domain-containing nogo receptor-interacting protein 1 |
| LINGO1 | 84894 | NP_001288116.1 | 283 | Leucine-rich repeat and immunoglobulin-like domain-containing nogo receptor-interacting protein 1 |
| LINGO1 | 84894 | NP_001288118.1 | 284 | Leucine-rich repeat and immunoglobulin-like domain-containing nogo receptor-interacting protein 1 |
| LINGO1 | 84894 | NP_001288120.1 | 285 | Leucine-rich repeat and immunoglobulin-like domain-containing nogo receptor-interacting protein 1 |
| LINGO1 | 84894 | NP_001288121.1 | 286 | Leucine-rich repeat and immunoglobulin-like domain-containing nogo receptor-interacting protein 1 |
| LINGO1 | 84894 | NP_001288123.1 | 287 | Leucine-rich repeat and immunoglobulin-like domain-containing nogo receptor-interacting protein 1 |
| LINGO1 | 84894 | NP_001288124.1 | 288 | Leucine-rich repeat and immunoglobulin-like domain-containing nogo receptor-interacting protein 1 |
| LINGO1 | 84894 | NP_001288126.1 | 289 | Leucine-rich repeat and immunoglobulin-like domain-containing nogo receptor-interacting protein 1 |
| LINGO1 | 84894 | NP_001288127.1 | 290 | Leucine-rich repeat and immunoglobulin-like domain-containing nogo receptor-interacting protein 1 |
| LINGO1 | 84894 | NP_001288128.1 | 291 | Leucine-rich repeat and immunoglobulin-like domain-containing nogo receptor-interacting protein 1 |
| LINGO1 | 84894 | NP_001288129.1 | 292 | Leucine-rich repeat and immunoglobulin-like domain-containing nogo receptor-interacting protein 1 |
| LINGO1 | 84894 | NP_116197.4 | 293 | Leucine-rich repeat and immunoglobulin-like domain-containing nogo receptor-interacting protein 1 |
| LPAR2 | 9170 | NP_004711.2 | 294 | Lysophosphatidic acid receptor 2 |
| LRP2 | 4036 | NP_004516.2 | 295 | Low-density lipoprotein receptor-related protein 2 |
| LRRC8D | 55144 | NP_001127951.1 | 296 | Volume-regulated anion channel subunit LRRC8D |
| LRRC8D | 55144 | NP_060573.2 | 297 | Volume-regulated anion channel subunit LRRC8D |
| LRRC8E | 80131 | NP_001255213.1 | 298 | Volume-regulated anion channel subunit LRRC8E |
| LRRC8E | 80131 | NP_001255214.1 | 299 | Volume-regulated anion channel subunit LRRC8E |
| LRRC8E | 80131 | NP_079337.2 | 300 | Volume-regulated anion channel subunit LRRC8E |
| LRRTM1 | 347730 | NP_849161.2 | 301 | Leucine-rich repeat transmembrane neuronal protein 1 |
| LSR | 51599 | NP_001247418.1 | 302 | Lipolysis-stimulated lipoprotein receptor |
| LSR | 51599 | NP_001247419.1 | 303 | Lipolysis-stimulated lipoprotein receptor |
| LSR | 51599 | NP_057009.3 | 304 | Lipolysis-stimulated lipoprotein receptor |
| LSR | 51599 | NP_991403.1 | 305 | Lipolysis-stimulated lipoprotein receptor |
| LSR | 51599 | NP_991404.1 | 306 | Lipolysis-stimulated lipoprotein receptor |
| MAGEA1 | 4100 | NP_004979.3 | 307 | Melanoma-associated antigen 1 |
| MAGT1 | 84061 | NP_115497.4 | 308 | Magnesium transporter protein 1 |
| MAL | 4118 | NP_002362.1 | 309 | Myelin and lymphocyte protein |
| MAL | 4118 | NP_071883.1 | 310 | Myelin and lymphocyte protein |
| MAL | 4118 | NP_071884.1 | 311 | Myelin and lymphocyte protein |
| MAL | 4118 | NP_071885.1 | 312 | Myelin and lymphocyte protein |
| MET | 4233 | NP_000236.2 | 313 | Hepatocyte growth factor receptor |
| MET | 4233 | NP_001120972.1 | 314 | Hepatocyte growth factor receptor |
| MLC1 | 23209 | NP_055981.1 | 315 | Membrane protein MLC1 |
| MLC1 | 23209 | NP_631941.1 | 316 | Membrane protein MLC1 |
| MMP14 | 4323 | NP_004986.1 | 317 | Matrix metalloproteinase-14 |
| MSLN | 10232 | NP_001170826.1 | 318 | Mesothelin |
| MSLN | 10232 | NP_005814.2 | 319 | Mesothelin |
| MSLN | 10232 | NP_037536.2 | 320 | Mesothelin |
| MUC1 | 4582 | NP_001018016.1 | 321 | Mucin-1 |
| MUC1 | 4582 | NP_001018017.1 | 322 | Mucin-1 |
| MUC1 | 4582 | NP_001037855.1 | 323 | Mucin-1 |
| MUC1 | 4582 | NP_001037856.1 | 324 | Mucin-1 |
| MUC1 | 4582 | NP_001037857.1 | 325 | Mucin-1 |
| MUC1 | 4582 | NP_001037858.1 | 326 | Mucin-1 |
| MUC1 | 4582 | NP_001191214.1 | 327 | Mucin-1 |
| MUC1 | 4582 | NP_001191215.1 | 328 | Mucin-1 |
| MUC1 | 4582 | NP_001191216.1 | 329 | Mucin-1 |
| MUC1 | 4582 | NP_001191217.1 | 330 | Mucin-1 |
| MUC1 | 4582 | NP_001191218.1 | 331 | Mucin-1 |
| MUC1 | 4582 | NP_001191219.1 | 332 | Mucin-1 |
| MUC1 | 4582 | NP_001191220.1 | 333 | Mucin-1 |
| MUC1 | 4582 | NP_001191221.1 | 334 | Mucin-1 |
| MUC1 | 4582 | NP_001191222.1 | 335 | Mucin-1 |
| MUC1 | 4582 | NP_001191223.1 | 336 | Mucin-1 |
| MUC1 | 4582 | NP_001191224.1 | 337 | Mucin-1 |
| MUC1 | 4582 | NP_001191225.1 | 338 | Mucin-1 |
| MUC1 | 4582 | NP_001191226.1 | 339 | Mucin-1 |
| MUC1 | 4582 | NP_002447.4 | 340 | Mucin-1 |
| MUC13 | 56667 | NP_149038.3 | 341 | Mucin-13 |
| NALCN | 259232 | NP_443099.1 | 342 | Sodium leak channel non-selective protein |
| NDRG4 | 65009 | NP_001123959.1 | 343 | Protein NDRG4 |
| NDRG4 | 65009 | NP_001229762.1 | 344 | Protein NDRG4 |
| NDRG4 | 65009 | NP_001229763.1 | 345 | Protein NDRG4 |
| NDRG4 | 65009 | NP_001229764.1 | 346 | Protein NDRG4 |

FIG. 2 (cont.)

| Antigen | GeneID | Accession No. | SEQ ID NO: | Gene Full Name |
|---|---|---|---|---|
| NDRG4 | 65009 | NP_001229765.1 | 347 | Protein NDRG4 |
| NDRG4 | 65009 | NP_065198.1 | 348 | Protein NDRG4 |
| NDRG4 | 65009 | NP_075061.1 | 349 | Protein NDRG4 |
| NLGN1 | 22871 | NP_055747.1 | 350 | Neuroligin-1 |
| NLGN3 | 54413 | NP_001160132.1 | 351 | Neuroligin-3 |
| NLGN3 | 54413 | NP_001308205.1 | 352 | Neuroligin-3 |
| NLGN3 | 54413 | NP_061850.2 | 353 | Neuroligin-3 |
| NLGN3 | 54413 | NP_851820.1 | 354 | Neuroligin-3 |
| NLGN4X | 57502 | NP_001269074.1 | 355 | Neuroligin-4, X-linked |
| NLGN4X | 57502 | NP_001269075.1 | 356 | Neuroligin-4, X-linked |
| NLGN4X | 57502 | NP_065793.1 | 357 | Neuroligin-4, X-linked |
| NLGN4X | 57502 | NP_851849.1 | 358 | Neuroligin-4, X-linked |
| NOX4 | 50507 | NP_001137308.1 | 359 | NADPH oxidase 4 |
| NOX4 | 50507 | NP_001137309.1 | 360 | NADPH oxidase 4 |
| NOX4 | 50507 | NP_001278855.1 | 361 | NADPH oxidase 4 |
| NOX4 | 50507 | NP_001278856.1 | 362 | NADPH oxidase 4 |
| NOX4 | 50507 | NP_001287924.1 | 363 | NADPH oxidase 4 |
| NOX4 | 50507 | NP_058627.1 | 364 | NADPH oxidase 4 |
| NPFFR1 | 64106 | NP_071429.1 | 365 | Neuropeptide FF receptor 1 |
| NRCAM | 4897 | NP_001032209.1 | 366 | Neuronal cell adhesion molecule |
| NRCAM | 4897 | NP_001180511.1 | 367 | Neuronal cell adhesion molecule |
| NRCAM | 4897 | NP_001180512.1 | 368 | Neuronal cell adhesion molecule |
| NRCAM | 4897 | NP_001180513.1 | 369 | Neuronal cell adhesion molecule |
| NRCAM | 4897 | NP_005001.3 | 370 | Neuronal cell adhesion molecule |
| NRP1 | 8829 | NP_001019799.1 | 371 | Neuropilin-1 |
| NRP1 | 8829 | NP_001019800.1 | 372 | Neuropilin-1 |
| NRP1 | 8829 | NP_001316997.1 | 373 | Neuropilin-1 |
| NRP1 | 8829 | NP_003864.4 | 374 | Neuropilin-1 |
| NRSN2 | 80023 | NP_001310608.1 | 375 | Neurensin-2 |
| NRSN2 | 80023 | NP_001310609.1 | 376 | Neurensin-2 |
| NRSN2 | 80023 | NP_001310610.1 | 377 | Neurensin-2 |
| NRSN2 | 80023 | NP_001310611.1 | 378 | Neurensin-2 |
| NRSN2 | 80023 | NP_001310612.1 | 379 | Neurensin-2 |
| NRSN2 | 80023 | NP_001310613.1 | 380 | Neurensin-2 |
| NRSN2 | 80023 | NP_001310614.1 | 381 | Neurensin-2 |
| NRSN2 | 80023 | NP_079234.1 | 382 | Neurensin-2 |
| NTRK2 | 4915 | NP_001007098.1 | 383 | BDNF/NT-3 growth factors receptor |
| NTRK2 | 4915 | NP_001018074.1 | 384 | BDNF/NT-3 growth factors receptor |
| NTRK2 | 4915 | NP_001018075.1 | 385 | BDNF/NT-3 growth factors receptor |
| NTRK2 | 4915 | NP_001018076.1 | 386 | BDNF/NT-3 growth factors receptor |
| NTRK2 | 4915 | NP_006171.2 | 387 | BDNF/NT-3 growth factors receptor |
| NTRK3 | 4916 | NP_001012338.1 | 388 | NT-3 growth factor receptor |
| NTRK3 | 4916 | NP_001307063.1 | 389 | NT-3 growth factor receptor |
| NTRK3 | 4916 | NP_001307064.1 | 390 | NT-3 growth factor receptor |
| NTRK3 | 4916 | NP_002521.2 | 391 | NT-3 growth factor receptor |
| P2RX1 | 5023 | NP_002549.1 | 392 | P2X purinoceptor 1 |
| PAQR9 | 344838 | NP_940906.1 | 393 | Progestin and adipoQ receptor family member 9 |
| PCDH9 | 5101 | NP_001305301.1 | 394 | Protocadherin-9 |
| PCDH9 | 5101 | NP_001305302.1 | 395 | Protocadherin-9 |
| PCDH9 | 5101 | NP_065136.1 | 396 | Protocadherin-9 |
| PCDH9 | 5101 | NP_982354.1 | 397 | Protocadherin-9 |
| PCDHB10 | 56126 | NP_061753.1 | 398 | Protocadherin beta-10 |
| PDGFRA | 5156 | NP_001334758.1 | 399 | Platelet-derived growth factor receptor alpha |
| PDGFRA | 5156 | NP_006197.1 | 400 | Platelet-derived growth factor receptor alpha |
| PDPN | 10630 | NP_001006625.1 | 401 | Podoplanin |
| PDPN | 10630 | NP_001006625.1 | 402 | Podoplanin |
| PDPN | 10630 | NP_006465.3 | 403 | Podoplanin |
| PDPN | 10630 | NP_938203.2 | 404 | Podoplanin |
| PIRT | 644139 | NP_001094857.1 | 405 | Phosphoinositide-interacting protein |
| PMEL | 6490 | NP_001186982.1 | 406 | Melanocyte protein PMEL |
| PMEL | 6490 | NP_001186983.1 | 407 | Melanocyte protein PMEL |
| PMEL | 6490 | NP_001307050.1 | 408 | Melanocyte protein PMEL |
| PMEL | 6490 | NP_001307051.1 | 409 | Melanocyte protein PMEL |
| PMEL | 6490 | NP_008859.1 | 410 | Melanocyte protein PMEL |
| PMEPA1 | 56937 | NP_001242905.1 | 411 | Protein TMEPAI |
| PMEPA1 | 56937 | NP_064567.2 | 412 | Protein TMEPAI |
| PMEPA1 | 56937 | NP_954638.1 | 413 | Protein TMEPAI |
| PMEPA1 | 56937 | NP_954639.1 | 414 | Protein TMEPAI |
| PMEPA1 | 56937 | NP_954640.1 | 415 | Protein TMEPAI |

FIG. 2 (cont.)

| Antigen | GeneID | Accession No. | SEQ ID NO: | Gene Full Name |
|---|---|---|---|---|
| PPAPDC1A | 196051 | NP_001025230.1 | 416 | Phospholipid phosphatase 4 (PLPP4) |
| PPAPDC1A | 196051 | NP_001305095.1 | 417 | Phospholipid phosphatase 4 (PLPP4) |
| PPAPDC1A | 196051 | NP_001305096.1 | 418 | Phospholipid phosphatase 4 (PLPP4) |
| PPAPDC1A | 196051 | NP_001305097.1 | 419 | Phospholipid phosphatase 4 (PLPP4) |
| PPAPDC1A | 196051 | NP_001305098.1 | 420 | Phospholipid phosphatase 4 (PLPP4) |
| PROM1 | 8842 | NP_001139319.1 | 421 | Prominin-1 |
| PROM1 | 8842 | NP_001139320.1 | 422 | Prominin-1 |
| PROM1 | 8842 | NP_001139321.1 | 423 | Prominin-1 |
| PROM1 | 8842 | NP_001139322.1 | 424 | Prominin-1 |
| PROM1 | 8842 | NP_001139323.1 | 425 | Prominin-1 |
| PROM1 | 8842 | NP_001139324.1 | 426 | Prominin-1 |
| PROM1 | 8842 | NP_006008.1 | 427 | Prominin-1 |
| PSCA | 8000 | AAH65183.1 | 543 | Prostate stem cell antigen |
| PSCA | 8000 | NP_005663.2 | 542 | Prostate stem cell antigen |
| PTH2R | 5746 | NP_001296445.1 | 428 | Parathyroid hormone 2 receptor |
| PTH2R | 5746 | NP_005039.1 | 429 | Parathyroid hormone 2 receptor |
| PTPRZ1 | 5803 | NP_001193767.1 | 430 | Receptor-type tyrosine-protein phosphatase zeta |
| PTPRZ1 | 5803 | NP_001193768.1 | 431 | Receptor-type tyrosine-protein phosphatase zeta |
| PTPRZ1 | 5803 | NP_002842.2 | 432 | Receptor-type tyrosine-protein phosphatase zeta |
| RAMP3 | 10268 | NP_005847.1 | 433 | Receptor activity-modifying protein 3 |
| RET | 5979 | NP_065681.1 | 434 | Proto-oncogene tyrosine-protein kinase receptor Ret |
| RET | 5979 | NP_066124.1 | 435 | Proto-oncogene tyrosine-protein kinase receptor Ret |
| ROR1 | 4919 | NP_001077061.1 | 436 | Inactive tyrosine-protein kinase transmembrane receptor ROR1 |
| ROR1 | 4919 | NP_005003.2 | 437 | Inactive tyrosine-protein kinase transmembrane receptor ROR1 |
| ROR2 | 4920 | NP_001305133.1 | 438 | Tyrosine-protein kinase transmembrane receptor ROR2 |
| ROR2 | 4920 | NP_004551.2 | 439 | Tyrosine-protein kinase transmembrane receptor ROR2 |
| SCN3A | 6328 | NP_001075145.1 | 440 | Sodium channel protein type 3 subunit alpha |
| SCN3A | 6328 | NP_001075146.1 | 441 | Sodium channel protein type 3 subunit alpha |
| SCN3A | 6328 | NP_008853.3 | 442 | Sodium channel protein type 3 subunit alpha |
| SCN3B | 55800 | NP_001035241.1 | 443 | Sodium channel subunit beta-3 |
| SCN3B | 55800 | NP_060870.1 | 444 | Sodium channel subunit beta-3 |
| SCN4A | 6329 | NP_000325.4 | 445 | Sodium channel protein type 4 subunit alpha |
| SCN4B | 6330 | NP_001135820.1 | 446 | Sodium channel subunit beta-4 |
| SCN4B | 6330 | NP_001135821.1 | 447 | Sodium channel subunit beta-4 |
| SCN4B | 6330 | NP_777594.1 | 448 | Sodium channel subunit beta-4 |
| SCNN1A | 6337 | NP_001029.1 | 449 | Amiloride-sensitive sodium channel subunit alpha |
| SCNN1A | 6337 | NP_001153047.1 | 450 | Amiloride-sensitive sodium channel subunit alpha |
| SCNN1A | 6337 | NP_001153048.1 | 451 | Amiloride-sensitive sodium channel subunit alpha |
| SEMA5A | 9037 | NP_003957.2 | 452 | Semaphorin-5A |
| SEMA5B | 54437 | NP_001026872.2 | 453 | Semaphorin-5B |
| SEMA5B | 54437 | NP_001243275.1 | 454 | Semaphorin-5B |
| SEMA5B | 54437 | NP_001243276.1 | 455 | Semaphorin-5B |
| SEZ6 | 124925 | NP_001092105.1 | 456 | Seizure protein 6 homolog |
| SEZ6 | 124925 | NP_001277131.1 | 457 | Seizure protein 6 homolog |
| SEZ6 | 124925 | NP_849191.3 | 458 | Seizure protein 6 homolog |
| SLC13A4 | 26266 | NP_001305121.1 | 459 | Solute carrier family 13 member 4 |
| SLC13A4 | 26266 | NP_036582.2 | 460 | Solute carrier family 13 member 4 |
| SLC16A4 | 9122 | NP_001188475.1 | 461 | Monocarboxylate transporter 5 |
| SLC16A4 | 9122 | NP_001188476.1 | 462 | Monocarboxylate transporter 5 |
| SLC16A4 | 9122 | NP_001188477.1 | 463 | Monocarboxylate transporter 5 |
| SLC16A4 | 9122 | NP_001188478.1 | 464 | Monocarboxylate transporter 5 |
| SLC16A4 | 9122 | NP_004687.1 | 465 | Monocarboxylate transporter 5 |
| SLC17A2 | 10246 | NP_001273052.1 | 466 | Sodium-dependent phosphate transport protein 3 |
| SLC17A2 | 10246 | NP_001273054.1 | 467 | Sodium-dependent phosphate transport protein 3 |
| SLC17A2 | 10246 | NP_005826.1 | 468 | Sodium-dependent phosphate transport protein 3 |
| SLC1A3 | 6507 | NP_001160167.1 | 469 | Excitatory amino acid transporter 1 |
| SLC1A3 | 6507 | NP_001276869.1 | 470 | Excitatory amino acid transporter 1 |
| SLC1A3 | 6507 | NP_004163.3 | 471 | Excitatory amino acid transporter 1 |
| SLC22A2 | 6582 | NP_003049.2 | 472 | Solute carrier family 22 member 2 |
| SLC26A9 | 115019 | NP_443166.1 | 473 | Solute carrier family 26 member 9 |
| SLC26A9 | 115019 | NP_599152.2 | 474 | Solute carrier family 26 member 9 |
| SLC28A3 | 64078 | NP_001186562.1 | 475 | Solute carrier family 28 member 3 |
| SLC28A3 | 64078 | NP_071410.1 | 476 | Solute carrier family 28 member 3 |
| SLC2A12 | 154091 | NP_660159.1 | 477 | Solute carrier family 2, facilitated glucose transporter member 12 |
| SLC2A2 | 6514 | NP_000331.1 | 478 | Solute carrier family 2, facilitated glucose transporter member 2 |
| SLC2A2 | 6514 | NP_001265587.1 | 479 | Solute carrier family 2, facilitated glucose transporter member 2 |
| SLC2A2 | 6514 | NP_001265588.1 | 480 | Solute carrier family 2, facilitated glucose transporter member 2 |
| SLC30A10 | 55532 | NP_061183.2 | 481 | Zinc transporter 10 |
| SLC38A1 | 81539 | NP_001070952.1 | 482 | Sodium-coupled neutral amino acid transporter 1 |

FIG. 2 (cont.)

| Antigen | GeneID | Accession No. | SEQ ID NO: | Gene Full Name |
|---|---|---|---|---|
| SLC38A1 | 81539 | NP_001265316.1 | 483 | Sodium-coupled neutral amino acid transporter 1 |
| SLC38A1 | 81539 | NP_001265317.1 | 484 | Sodium-coupled neutral amino acid transporter 1 |
| SLC38A1 | 81539 | NP_001265318.1 | 485 | Sodium-coupled neutral amino acid transporter 1 |
| SLC38A1 | 81539 | NP_109599.3 | 486 | Sodium-coupled neutral amino acid transporter 1 |
| SLC38A6 | 145389 | NP_001166173.1 | 487 | Probable sodium-coupled neutral amino acid transporter 6 |
| SLC38A6 | 145389 | NP_722518.2 | 488 | Probable sodium-coupled neutral amino acid transporter 6 |
| SLC3A1 | 6519 | NP_000332.2 | 489 | Neutral and basic amino acid transport protein rBAT |
| SLC46A1 | 113235 | NP_001229295.1 | 490 | Proton-coupled folate transporter |
| SLC46A1 | 113235 | NP_542400.2 | 491 | Proton-coupled folate transporter |
| SLC5A6 | 8884 | NP_066918.2 | 492 | Sodium-dependent multivitamin transporter |
| SLC6A1 | 6529 | NP_001335179.1 | 493 | Sodium- and chloride-dependent GABA transporter 1 |
| SLC6A1 | 6529 | NP_003033.3 | 494 | Sodium- and chloride-dependent GABA transporter 1 |
| SLC6A14 | 11254 | NP_009162.1 | 495 | Sodium- and chloride-dependent neutral and basic amino acid transporter B(0+) |
| SLC6A4 | 6532 | NP_001036.1 | 496 | Sodium-dependent serotonin transporter |
| SLC8A3 | 6547 | NP_001123889.1 | 497 | Sodium/calcium exchanger 3 |
| SLC8A3 | 6547 | NP_150287.1 | 498 | Sodium/calcium exchanger 3 |
| SLC8A3 | 6547 | NP_489479.1 | 499 | Sodium/calcium exchanger 3 |
| SLC8A3 | 6547 | NP_891977.1 | 500 | Sodium/calcium exchanger 3 |
| SLC8A3 | 6547 | NP_891981.1 | 501 | Sodium/calcium exchanger 3 |
| SLC8A3 | 6547 | NP_892114.1 | 502 | Sodium/calcium exchanger 3 |
| SLCO1B1 | 10599 | NP_006437.3 | 503 | Solute carrier organic anion transporter family member 1B1 |
| SLCO4C1 | 353189 | NP_851322.3 | 504 | Solute carrier organic anion transporter family member 4C1 |
| SSX1 | 6756 | NP_001265620.1 | 505 | Protein SSX1 |
| SSX1 | 6756 | NP_005626.1 | 506 | Protein SSX1 |
| ST3GAL5 | 8869 | NP_001035902.1 | 507 | Lactosylceramide alpha-2,3-sialyltransferase |
| ST3GAL5 | 8869 | NP_003887.3 | 508 | Lactosylceramide alpha-2,3-sialyltransferase |
| STAB2 | 55576 | NP_060034.9 | 509 | Stabilin-2 |
| SYT13 | 57586 | NP_065877.1 | 510 | Synaptotagmin-13 |
| TGFBR3 | 7049 | NP_001182612.1 | 511 | Transforming growth factor beta receptor type 3 |
| TGFBR3 | 7049 | NP_001182613.1 | 512 | Transforming growth factor beta receptor type 3 |
| TGFBR3 | 7049 | NP_003234.2 | 513 | Transforming growth factor beta receptor type 3 |
| THY1 | 7070 | NP_001298089.1 | 514 | Thy-1 membrane glycoprotein |
| THY1 | 7070 | NP_001298091.1 | 515 | Thy-1 membrane glycoprotein |
| THY1 | 7070 | NP_006279.2 | 516 | Thy-1 membrane glycoprotein |
| TMEM100 | 55273 | NP_001093110.1 | 517 | Transmembrane protein 100 |
| TMEM100 | 55273 | NP_060756.2 | 518 | Transmembrane protein 100 |
| TMEM150B | 284417 | NP_001078957.1 | 519 | Transmembrane protein 150B |
| TMEM150B | 284417 | NP_001268940.1 | 520 | Transmembrane protein 150B |
| TMEM17 | 200728 | NP_938017.2 | 521 | Transmembrane protein 17 |
| TMEM27 | 57393 | NP_065716.1 | 522 | Collectrin |
| TNFSF4 | 7292 | NP_001284491.1 | 523 | Tumor necrosis factor ligand superfamily member 4 |
| TNFSF4 | 7292 | NP_003317.1 | 524 | Tumor necrosis factor ligand superfamily member 4 |
| TNFSF9 | 8744 | NP_003802.1 | 525 | Tumor necrosis factor ligand superfamily member 9 |
| TPBG | 7162 | NP_001159864.1 | 526 | Trophoblast glycoprotein |
| TPBG | 7162 | NP_006661.1 | 527 | Trophoblast glycoprotein |
| TREM2 | 54209 | NP_001258750.1 | 528 | Triggering receptor expressed on myeloid cells 2 |
| TREM2 | 54209 | NP_061838.1 | 529 | Triggering receptor expressed on myeloid cells 2 |
| TRPM8 | 79054 | NP_076985.4 | 530 | Transient receptor potential cation channel subfamily M member 8 |
| TSPAN1 | 10103 | NP_005718.2 | 531 | Tetraspanin-1 |
| TSPAN11 | 441631 | NP_001073978.1 | 532 | Tetraspanin-11 |
| TTYH3 | 80727 | NP_079526.1 | 533 | Protein tweety homolog 3 |
| VSIG1 | 340547 | NP_001164024.1 | 534 | V-set and immunoglobulin domain-containing protein 1 |
| VSIG1 | 340547 | NP_872413.1 | 535 | V-set and immunoglobulin domain-containing protein 1 |
| VTCN1 | 79679 | NP_001240778.1 | 536 | V-set domain-containing T-cell activation inhibitor 1 |
| VTCN1 | 79679 | NP_001240779.1 | 537 | V-set domain-containing T-cell activation inhibitor 1 |
| VTCN1 | 79679 | NP_078902.2 | 538 | V-set domain-containing T-cell activation inhibitor 1 |
| WLS | 79971 | NP_001002292.3 | 539 | Protein wntless homolog |
| WLS | 79971 | NP_001180263.1 | 540 | Protein wntless homolog |
| WLS | 79971 | NP_079187.3 | 541 | Protein wntless homolog |

2 INPUT "AND" GATE with antigens A AND X

2 INPUT "AND-NOT" GATE with antigens X AND-NOT A

FIG. 6

| Antigen Pair Logic | F1 | Precision | Recall |
|---|---|---|---|
| Glioblastoma (Glioblastoma) | | | |
| PTPRZ1 | 0.9375 | 1 | 0.882353 |
| PTPRZ1 AND FOLR2 | 0.903226 | 1 | 0.823529 |
| PTPRZ1 AND IGF1R | 0.9375 | 1 | 0.882353 |
| PTPRZ1 AND NCAM1 | 0.9375 | 1 | 0.882353 |
| PTPRZ1 AND CD70 | 0.9375 | 1 | 0.882353 |
| PTPRZ1 AND AXL | 0.903226 | 1 | 0.823529 |
| PTPRZ1 AND CDH5 | 0.9375 | 1 | 0.882353 |
| PTPRZ1 AND SCAMP2 | 0.903226 | 1 | 0.823529 |
| PTPRZ1 AND TENM1 | 0.9375 | 1 | 0.882353 |
| PTPRZ1 AND LHFPL2 | 0.903226 | 1 | 0.823529 |
| PTPRZ1 AND BTN3A3 | 0.9375 | 1 | 0.882353 |
| PTPRZ1 AND CRTAP | 0.9375 | 1 | 0.882353 |
| PTPRZ1 AND PRDX4 | 0.9375 | 1 | 0.882353 |
| PTPRZ1 AND IFITM2 | 0.903226 | 1 | 0.823529 |
| PTPRZ1 AND TNFSF13B | 0.9375 | 1 | 0.882353 |
| PTPRZ1 AND CERS1 | 0.9375 | 1 | 0.882353 |
| PTPRZ1 AND VAMP5 | 0.9375 | 1 | 0.882353 |
| PTPRZ1 AND USP19 | 0.903226 | 1 | 0.823529 |
| PTPRZ1 AND ADAM29 | 0.903226 | 1 | 0.823529 |
| PTPRZ1 AND BTN3A2 | 0.903226 | 1 | 0.823529 |
| PTPRZ1 AND BTN3A1 | 0.903226 | 1 | 0.823529 |
| PTPRZ1 AND CHI3L2 | 0.903226 | 1 | 0.823529 |
| PTPRZ1 AND MGAT4A | 0.9375 | 1 | 0.882353 |
| PTPRZ1 AND SDSL | 0.903226 | 1 | 0.823529 |
| PTPRZ1 AND CSMD2 | 0.903226 | 1 | 0.823529 |
| PTPRZ1 AND TMEM132B | 0.903226 | 1 | 0.823529 |
| PTPRZ1 AND MARCH3 | 0.903226 | 1 | 0.823529 |
| PTPRZ1 AND TM4SF18 | 0.903226 | 1 | 0.823529 |
| PTPRZ1 AND ANTXR2 | 0.903226 | 1 | 0.823529 |
| PTPRZ1 AND FAT3 | 0.903226 | 1 | 0.823529 |
| PTPRZ1 AND CCR1 | 0.903226 | 1 | 0.823529 |
| PTPRZ1 AND FAM69C | 0.903226 | 1 | 0.823529 |
| PTPRZ1 AND B3GALT6 | 0.903226 | 1 | 0.823529 |
| PTPRZ1 AND CNR1 | 0.9375 | 1 | 0.882353 |
| PTPRZ1 AND SLC44A3 | 0.9375 | 1 | 0.882353 |
| PTPRZ1 AND DRAM2 | 0.9375 | 1 | 0.882353 |
| PTPRZ1 AND C1orf162 | 0.9375 | 1 | 0.882353 |
| PTPRZ1 AND EMID1 | 0.903226 | 1 | 0.823529 |
| PTPRZ1 AND COMT | 0.903226 | 1 | 0.823529 |
| PTPRZ1 AND B3GAT2 | 0.903226 | 1 | 0.823529 |
| PTPRZ1 AND PTCHD1 | 0.9375 | 1 | 0.882353 |
| PTPRZ1 AND ROMO1 | 0.9375 | 1 | 0.882353 |
| PTPRZ1 AND ADORA3 | 0.903226 | 1 | 0.823529 |
| PTPRZ1 AND SAMD8 | 0.9375 | 1 | 0.882353 |
| PTPRZ1 AND CSF1R | 0.903226 | 1 | 0.823529 |
| PTPRZ1 AND B3GLCT | 0.903226 | 1 | 0.823529 |
| PTPRZ1 AND CTNS | 0.903226 | 1 | 0.823529 |
| PTPRZ1 AND IGSF11 | 0.9375 | 1 | 0.882353 |
| PTPRZ1 AND PAQR3 | 0.903226 | 1 | 0.823529 |
| PTPRZ1 AND CYBA | 0.903226 | 1 | 0.823529 |
| PTPRZ1 AND RDH10 | 0.903226 | 1 | 0.823529 |
| PTPRZ1 AND DSCAM | 0.903226 | 1 | 0.823529 |
| PTPRZ1 AND DTNA | 0.9375 | 1 | 0.882353 |

| Antigen Pair Logic | F1 | Precision | Recall |
|---|---|---|---|
| (cont.) | | | |
| PTPRZ1 AND ITGAV | 0.985294 | 1 | 0.971014 |
| ITGAV AND WRB | 0.970149 | 1 | 0.942029 |
| ITGAV AND TMX1 | 0.970149 | 1 | 0.942029 |
| ITGAV AND PKD2L1 | 0.970149 | 1 | 0.942029 |
| PTPRZ1 AND TMEM179B | 0.992701 | 1 | 0.985507 |
| PTPRZ1 AND TMEM205 | 0.992701 | 1 | 0.985507 |
| PTPRZ1 AND KCNH2 | 0.985294 | 1 | 0.971014 |
| PTPRZ1 AND KDR | 0.977778 | 1 | 0.956522 |
| PTPRZ1 AND LAMP1 | 0.970149 | 1 | 0.942029 |
| PTPRZ1 AND ARHGAP1 | 0.985294 | 1 | 0.971014 |
| PTPRZ1 AND LBR | 0.985294 | 1 | 0.971014 |
| PTPRZ1 AND C4orf3 | 0.977778 | 1 | 0.956522 |
| PTPRZ1 AND LTBP3 | 0.970149 | 1 | 0.942029 |
| PTPRZ1 AND MARS | 0.985294 | 1 | 0.971014 |
| PTPRZ1 AND MCL1 | 0.985294 | 1 | 0.971014 |
| PTPRZ1 AND MFAP3 | 0.977778 | 1 | 0.956522 |
| PTPRZ1 AND MGAT2 | 0.985294 | 1 | 0.971014 |
| PTPRZ1 AND MGAT5 | 0.977778 | 1 | 0.956522 |
| PTPRZ1 AND MGP | 0.985294 | 1 | 0.971014 |
| PTPRZ1 AND MPG | 0.977778 | 1 | 0.956522 |
| PTPRZ1 AND ASPH | 0.985294 | 1 | 0.971014 |
| PTPRZ1 AND MTHFD1 | 0.992701 | 1 | 0.985507 |
| PTPRZ1 AND NDUFA3 | 0.992701 | 1 | 0.985507 |
| PTPRZ1 AND NDUFA4 | 0.992701 | 1 | 0.985507 |
| PTPRZ1 AND NDUFB1 | 0.992701 | 1 | 0.985507 |
| PTPRZ1 AND NDUFB5 | 0.977778 | 1 | 0.956522 |
| PTPRZ1 AND NDUFB6 | 0.985294 | 1 | 0.971014 |
| ATP1B2 AND TMEM14C | 0.970149 | 1 | 0.942029 |
| PTPRZ1 AND ATP1B3 | 0.992701 | 1 | 0.985507 |
| PTPRZ1 AND NOTCH4 | 0.992701 | 1 | 0.985507 |
| PTPRZ1 AND ATP2A1 | 0.970149 | 1 | 0.942029 |
| PTPRZ1 AND ATP2A2 | 0.985294 | 1 | 0.971014 |
| PTPRZ1 AND OXA1L | 0.992701 | 1 | 0.985507 |
| PTPRZ1 AND P2RX4 | 0.977778 | 1 | 0.956522 |
| PTPRZ1 AND RRM2B | 0.985294 | 1 | 0.971014 |
| PTPRZ1 AND CHST11 | 0.977778 | 1 | 0.956522 |
| PTPRZ1 AND PAM | 0.992701 | 1 | 0.985507 |
| PTPRZ1 AND TMED5 | 0.992701 | 1 | 0.985507 |
| PTPRZ1 AND SLC35C2 | 0.977778 | 1 | 0.956522 |
| PTPRZ1 AND DERL2 | 0.977778 | 1 | 0.956522 |
| PTPRZ1 AND TMED7 | 0.970149 | 1 | 0.942029 |
| PTPRZ1 AND FIS1 | 0.985294 | 1 | 0.971014 |
| PTPRZ1 AND GOLT1B | 0.977778 | 1 | 0.956522 |
| PTPRZ1 AND TXNDC12 | 0.992701 | 1 | 0.985507 |
| PTPRZ1 AND SCCPDH | 0.992701 | 1 | 0.985507 |
| PTPRZ1 AND IER3IP1 | 0.992701 | 1 | 0.985507 |
| PTPRZ1 AND CKLF | 0.977778 | 1 | 0.956522 |
| PTPRZ1 AND EMC4 | 0.992701 | 1 | 0.985507 |
| PTPRZ1 AND SHISA5 | 0.992701 | 1 | 0.985507 |
| PTPRZ1 AND TMEM69 | 0.992701 | 1 | 0.985507 |
| PTPRZ1 AND NT5C3A | 0.970149 | 1 | 0.942029 |
| PTPRZ1 AND TBC1D7 | 0.992701 | 1 | 0.985507 |
| PTPRZ1 AND BFAR | 0.992701 | 1 | 0.985507 |

FIG. 6 (cont.)

| Antigen Pair Logic | F1 | Precision | Recall |
|---|---|---|---|
| PTPRZ1 AND GPR183 | 0.903226 | 1 | 0.823529 |
| PTPRZ1 AND EDNRB | 0.9375 | 1 | 0.882353 |
| PTPRZ1 AND ABCA1 | 0.903226 | 1 | 0.823529 |
| PTPRZ1 AND EMP1 | 0.903226 | 1 | 0.823529 |
| PTPRZ1 AND MPEG1 | 0.903226 | 1 | 0.823529 |
| PTPRZ1 AND ABCA3 | 0.903226 | 1 | 0.823529 |
| PTPRZ1 AND CYB561A3 | 0.9375 | 1 | 0.882353 |
| PTPRZ1 AND HEPACAM | 0.9375 | 1 | 0.882353 |
| PTPRZ1 AND SLC16A9 | 0.9375 | 1 | 0.882353 |
| PTPRZ1 AND FKTN | 0.9375 | 1 | 0.882353 |
| PTPRZ1 AND TMED4 | 0.903226 | 1 | 0.823529 |
| PTPRZ1 AND NLGN1 | 0.9375 | 1 | 0.882353 |
| PTPRZ1 AND KLHDC10 | 0.9375 | 1 | 0.882353 |
| PTPRZ1 AND NFASC | 0.903226 | 1 | 0.823529 |
| PTPRZ1 AND ANKLE2 | 0.903226 | 1 | 0.823529 |
| PTPRZ1 AND GRAMD4 | 0.9375 | 1 | 0.882353 |
| PTPRZ1 AND STAB1 | 0.903226 | 1 | 0.823529 |
| PTPRZ1 AND SYT11 | 0.9375 | 1 | 0.882353 |
| PTPRZ1 AND MLC1 | 0.903226 | 1 | 0.823529 |
| PTPRZ1 AND ASTN2 | 0.9375 | 1 | 0.882353 |
| PTPRZ1 AND WSCD1 | 0.903226 | 1 | 0.823529 |
| PTPRZ1 AND NPTXR | 0.903226 | 1 | 0.823529 |
| PTPRZ1 AND TRAM1 | 0.9375 | 1 | 0.882353 |
| PTPRZ1 AND FPR1 | 0.9375 | 1 | 0.882353 |
| PTPRZ1 AND SLC7A11 | 0.9375 | 1 | 0.882353 |
| PTPRZ1 AND CADM1 | 0.9375 | 1 | 0.882353 |
| PTPRZ1 AND PANX1 | 0.903226 | 1 | 0.823529 |
| PTPRZ1 AND CADM2 | 0.903226 | 1 | 0.823529 |
| PTPRZ1 AND SLC39A6 | 0.9375 | 1 | 0.882353 |
| PTPRZ1 AND LRRTM2 | 0.9375 | 1 | 0.882353 |
| PTPRZ1 AND GIMAP2 | 0.903226 | 1 | 0.823529 |
| PTPRZ1 AND TMEM251 | 0.903226 | 1 | 0.823529 |
| PTPRZ1 AND AMFR | 0.903226 | 1 | 0.823529 |
| PTPRZ1 AND PCDH17 | 0.903226 | 1 | 0.823529 |
| PTPRZ1 AND GOLIM4 | 0.903226 | 1 | 0.823529 |
| PTPRZ1 AND SLCO1B3 | 0.903226 | 1 | 0.823529 |
| PTPRZ1 AND GPM6B | 0.903226 | 1 | 0.823529 |
| GPM6B AND GAL3ST4 | 0.914286 | 0.888889 | 0.941176 |
| PTPRZ1 AND GPR34 | 0.903226 | 1 | 0.823529 |
| PTPRZ1 AND XKR6 | 0.903226 | 1 | 0.823529 |
| PTPRZ1 AND GPR37 | 0.903226 | 1 | 0.823529 |
| PTPRZ1 AND GRIA3 | 0.9375 | 1 | 0.882353 |
| PTPRZ1 AND TMEM176B | 0.903226 | 1 | 0.823529 |
| PTPRZ1 AND GRIK2 | 0.903226 | 1 | 0.823529 |
| PTPRZ1 AND GRIN2C | 0.903226 | 1 | 0.823529 |
| PTPRZ1 AND CERS2 | 0.9375 | 1 | 0.882353 |
| PTPRZ1 AND HLA-B | 0.9375 | 1 | 0.882353 |
| PTPRZ1 AND HLA-DMA | 0.903226 | 1 | 0.823529 |
| PTPRZ1 AND HLA-DMB | 0.903226 | 1 | 0.823529 |
| PTPRZ1 AND HLA-DRA | 0.903226 | 1 | 0.823529 |
| PTPRZ1 AND HLA-DRB1 | 0.903226 | 1 | 0.823529 |
| PTPRZ1 AND HLA-F | 0.903226 | 1 | 0.823529 |
| PTPRZ1 AND APLP2 | 0.9375 | 1 | 0.882353 |
| PTPRZ1 AND TMEM119 | 0.903226 | 1 | 0.823529 |

| Antigen Pair Logic | F1 | Precision | Recall |
|---|---|---|---|
| PTPRZ1 AND ERGIC2 | 0.985294 | 1 | 0.971014 |
| PTPRZ1 AND TIMMDC1 | 0.985294 | 1 | 0.971014 |
| PTPRZ1 AND ARMCX1 | 0.985294 | 1 | 0.971014 |
| PTPRZ1 AND CHST15 | 0.977778 | 1 | 0.956522 |
| PTPRZ1 AND ATRAID | 0.985294 | 1 | 0.971014 |
| PTPRZ1 AND WDR83OS | 0.985294 | 1 | 0.971014 |
| PTPRZ1 AND TMEM14C | 0.985294 | 1 | 0.971014 |
| PTPRZ1 AND TMEM138 | 0.985294 | 1 | 0.971014 |
| PTPRZ1 AND ARMCX3 | 0.992701 | 1 | 0.985507 |
| PTPRZ1 AND CUTA | 0.970149 | 1 | 0.942029 |
| GPR158 AND ATP5F1 | 0.977778 | 1 | 0.956522 |
| PTPRZ1 AND ATP5F1 | 0.985294 | 1 | 0.971014 |
| PTPRZ1 AND PIGT | 0.992701 | 1 | 0.985507 |
| PTPRZ1 AND ERGIC3 | 0.985294 | 1 | 0.971014 |
| PTPRZ1 AND SLC25A39 | 0.977778 | 1 | 0.956522 |
| PTPRZ1 AND DHRS7 | 0.970149 | 1 | 0.942029 |
| PTPRZ1 AND TMBIM4 | 0.992701 | 1 | 0.985507 |
| PTPRZ1 AND PTRH2 | 0.992701 | 1 | 0.985507 |
| PTPRZ1 AND FKBP7 | 0.992701 | 1 | 0.985507 |
| PTPRZ1 AND DNAJB11 | 0.992701 | 1 | 0.985507 |
| PTPRZ1 AND PECAM1 | 0.992701 | 1 | 0.985507 |
| PTPRZ1 AND SLC25A3 | 0.992701 | 1 | 0.985507 |
| PTPRZ1 AND ATP6V0C | 0.992701 | 1 | 0.985507 |
| PTPRZ1 AND PIGF | 0.977778 | 1 | 0.956522 |
| PTPRZ1 AND ACP1 | 0.985294 | 1 | 0.971014 |
| PTPRZ1 AND ATP6V0B | 0.992701 | 1 | 0.985507 |
| PTPRZ1 AND ATP6AP1 | 0.977778 | 1 | 0.956522 |
| PTPRZ1 AND SLC38A2 | 0.977778 | 1 | 0.956522 |
| PTPRZ1 AND DNAJC10 | 0.970149 | 1 | 0.942029 |
| PTPRZ1 AND TMCO1 | 0.977778 | 1 | 0.956522 |
| PTPRZ1 AND NDUFB11 | 0.985294 | 1 | 0.971014 |
| PTPRZ1 AND SLC35F2 | 0.977778 | 1 | 0.956522 |
| PTPRZ1 AND LEPROT | 0.992701 | 1 | 0.985507 |
| PTPRZ1 AND CTSA | 0.970149 | 1 | 0.942029 |
| PTPRZ1 AND PPIB | 0.970149 | 1 | 0.942029 |
| PTPRZ1 AND CMTM6 | 0.977778 | 1 | 0.956522 |
| PTPRZ1 AND TMEM161A | 0.985294 | 1 | 0.971014 |
| PTPRZ1 AND PIGX | 0.985294 | 1 | 0.971014 |
| PTPRZ1 AND TMEM70 | 0.992701 | 1 | 0.985507 |
| PTPRZ1 AND TMEM255A | 0.977778 | 1 | 0.956522 |
| TMEM255A AND WRB | 0.970149 | 1 | 0.942029 |
| PTPRZ1 AND SLC35A5 | 0.977778 | 1 | 0.956522 |
| PTPRZ1 AND TMEM248 | 0.985294 | 1 | 0.971014 |
| PTPRZ1 AND TMEM45A | 0.985294 | 1 | 0.971014 |
| PTPRZ1 AND TMEM33 | 0.970149 | 1 | 0.942029 |
| PTPRZ1 AND TMEM39A | 0.985294 | 1 | 0.971014 |
| PTPRZ1 AND AGPAT5 | 0.977778 | 1 | 0.956522 |
| PTPRZ1 AND DRAM1 | 0.970149 | 1 | 0.942029 |
| PTPRZ1 AND LAPTM4B | 0.977778 | 1 | 0.956522 |
| PTPRZ1 AND CSGALNACT2 | 0.992701 | 1 | 0.985507 |
| PTPRZ1 AND PRCP | 0.977778 | 1 | 0.956522 |
| PTPRZ1 AND PARL | 0.985294 | 1 | 0.971014 |
| PTPRZ1 AND ETNK1 | 0.985294 | 1 | 0.971014 |
| PTPRZ1 AND ZDHHC7 | 0.977778 | 1 | 0.956522 |

FIG. 6 (cont.)

| Antigen Pair Logic | F1 | Precision | Recall | Antigen Pair Logic | F1 | Precision | Recall |
|---|---|---|---|---|---|---|---|
| PTPRZ1 AND TSPAN33 | 0.903226 | 1 | 0.823529 | PTPRZ1 AND FLVCR2 | 0.985294 | 1 | 0.971014 |
| PTPRZ1 AND APOC1 | 0.9375 | 1 | 0.882353 | PTPRZ1 AND TMEM127 | 0.977778 | 1 | 0.956522 |
| PTPRZ1 AND IGF1R | 0.9375 | 1 | 0.882353 | PTPRZ1 AND SLC30A6 | 0.977778 | 1 | 0.956522 |
| PTPRZ1 AND IL6R | 0.903226 | 1 | 0.823529 | PTPRZ1 AND TMEM30A | 0.970149 | 1 | 0.942029 |
| PTPRZ1 AND IL10RA | 0.903226 | 1 | 0.823529 | PTPRZ1 AND NGLY1 | 0.992701 | 1 | 0.985507 |
| PTPRZ1 AND IL13RA1 | 0.903226 | 1 | 0.823529 | PTPRZ1 AND RNF130 | 0.970149 | 1 | 0.942029 |
| PTPRZ1 AND AQP4 | 0.9375 | 1 | 0.882353 | PTPRZ1 AND PAG1 | 0.970149 | 1 | 0.942029 |
| PTPRZ1 AND ITGA2 | 0.9375 | 1 | 0.882353 | PTPRZ1 AND VIMP | 0.985294 | 1 | 0.971014 |
| PTPRZ1 AND ITGAM | 0.903226 | 1 | 0.823529 | PTPRZ1 AND GLT8D1 | 0.970149 | 1 | 0.942029 |
| PTPRZ1 AND TMEM179B | 0.903226 | 1 | 0.823529 | PTPRZ1 AND EMC3 | 0.970149 | 1 | 0.942029 |
| PTPRZ1 AND LHFPL4 | 0.9375 | 1 | 0.882353 | PTPRZ1 AND PLGRKT | 0.970149 | 1 | 0.942029 |
| PTPRZ1 AND LHFPL3 | 0.903226 | 1 | 0.823529 | PTPRZ1 AND ECHDC1 | 0.985294 | 1 | 0.971014 |
| PTPRZ1 AND KCNJ8 | 0.903226 | 1 | 0.823529 | PTPRZ1 AND TMEM126B | 0.985294 | 1 | 0.971014 |
| PTPRZ1 AND KCNJ10 | 0.9375 | 1 | 0.882353 | PTPRZ1 AND BCAP29 | 0.970149 | 1 | 0.942029 |
| PTPRZ1 AND C10orf99 | 0.9375 | 1 | 0.882353 | PTPRZ1 AND DIABLO | 0.970149 | 1 | 0.942029 |
| PTPRZ1 AND GLTPD2 | 0.903226 | 1 | 0.823529 | PTPRZ1 AND PSEN1 | 0.970149 | 1 | 0.942029 |
| PTPRZ1 AND OR51B6 | 0.903226 | 1 | 0.823529 | PTPRZ1 AND NPDC1 | 0.985294 | 1 | 0.971014 |
| PTPRZ1 AND LTBP3 | 0.903226 | 1 | 0.823529 | PTPRZ1 AND TMEM9B | 0.992701 | 1 | 0.985507 |
| PTPRZ1 AND MARS | 0.903226 | 1 | 0.823529 | PTPRZ1 AND EMC7 | 0.977778 | 1 | 0.956522 |
| PTPRZ1 AND MFAP3 | 0.903226 | 1 | 0.823529 | PTPRZ1 AND C5orf15 | 0.977778 | 1 | 0.956522 |
| PTPRZ1 AND CD99 | 0.9375 | 1 | 0.882353 | PTPRZ1 AND ACKR3 | 0.985294 | 1 | 0.971014 |
| PTPRZ1 AND MMP16 | 0.903226 | 1 | 0.823529 | PTPRZ1 AND ATP13A1 | 0.970149 | 1 | 0.942029 |
| PTPRZ1 AND FAM26F | 0.903226 | 1 | 0.823529 | PTPRZ1 AND SLC44A2 | 0.985294 | 1 | 0.971014 |
| PTPRZ1 AND ASTN1 | 0.9375 | 1 | 0.882353 | PTPRZ1 AND SNX14 | 0.992701 | 1 | 0.985507 |
| PTPRZ1 AND NCAM1 | 0.9375 | 1 | 0.882353 | PTPRZ1 AND CYP20A1 | 0.977778 | 1 | 0.956522 |
| PTPRZ1 AND ATP1A2 | 0.9375 | 1 | 0.882353 | PTPRZ1 AND MAVS | 0.970149 | 1 | 0.942029 |
| PTPRZ1 AND NMB | 0.903226 | 1 | 0.823529 | GPR158 AND PTTG1IP | 0.977778 | 1 | 0.956522 |
| PTPRZ1 AND ATP1B2 | 0.9375 | 1 | 0.882353 | PTPRZ1 AND PTPN2 | 0.992701 | 1 | 0.985507 |
| PTPRZ1 AND ATP2A2 | 0.9375 | 1 | 0.882353 | PTPRZ1 AND PEX2 | 0.977778 | 1 | 0.956522 |
| PTPRZ1 AND P2RY1 | 0.903226 | 1 | 0.823529 | PTPRZ1 AND MS4A7 | 0.970149 | 1 | 0.942029 |
| PTPRZ1 AND CLEC4A | 0.9375 | 1 | 0.882353 | PTPRZ1 AND JAM2 | 0.985294 | 1 | 0.971014 |
| PTPRZ1 AND TMED5 | 0.9375 | 1 | 0.882353 | PTPRZ1 AND OSTC | 0.985294 | 1 | 0.971014 |
| PTPRZ1 AND SLC35C2 | 0.903226 | 1 | 0.823529 | PTPRZ1 AND SELK | 0.977778 | 1 | 0.956522 |
| PTPRZ1 AND PCDH8 | 0.9375 | 1 | 0.882353 | PTPRZ1 AND RBM3 | 0.992701 | 1 | 0.985507 |
| PTPRZ1 AND NDUFA13 | 0.9375 | 1 | 0.882353 | PTPRZ1 AND RPN1 | 0.970149 | 1 | 0.942029 |
| PTPRZ1 AND GAL | 0.903226 | 1 | 0.823529 | PTPRZ1 AND RPN2 | 0.992701 | 1 | 0.985507 |
| PTPRZ1 AND PIPOX | 0.903226 | 1 | 0.823529 | PTPRZ1 AND RYK | 0.992701 | 1 | 0.985507 |
| PTPRZ1 AND SLC22A17 | 0.903226 | 1 | 0.823529 | PTPRZ1 AND CCL4 | 0.977778 | 1 | 0.956522 |
| PTPRZ1 AND MBTPS2 | 0.9375 | 1 | 0.882353 | PTPRZ1 AND SRR | 0.977778 | 1 | 0.956522 |
| PTPRZ1 AND CHST15 | 0.903226 | 1 | 0.823529 | PTPRZ1 AND SDCBP | 0.985294 | 1 | 0.971014 |
| PTPRZ1 AND RHCG | 0.9375 | 1 | 0.882353 | PTPRZ1 AND MANBAL | 0.992701 | 1 | 0.985507 |
| PTPRZ1 AND TMEM138 | 0.9375 | 1 | 0.882353 | PTPRZ1 AND MCUR1 | 0.977778 | 1 | 0.956522 |
| PTPRZ1 AND ERGIC3 | 0.9375 | 1 | 0.882353 | PTPRZ1 AND ADGRL4 | 0.970149 | 1 | 0.942029 |
| PTPRZ1 AND DNAJB11 | 0.9375 | 1 | 0.882353 | PTPRZ1 AND MS4A6A | 0.970149 | 1 | 0.942029 |
| PTPRZ1 AND PECAM1 | 0.903226 | 1 | 0.823529 | PTPRZ1 AND C5orf28 | 0.970149 | 1 | 0.942029 |
| PTPRZ1 AND CECR1 | 0.903226 | 1 | 0.823529 | PTPRZ1 AND PCNXL4 | 0.992701 | 1 | 0.985507 |
| PTPRZ1 AND PLP1 | 0.903226 | 1 | 0.823529 | PTPRZ1 AND SGCB | 0.985294 | 1 | 0.971014 |
| PTPRZ1 AND PLXNA1 | 0.903226 | 1 | 0.823529 | PTPRZ1 AND SLC30A5 | 0.985294 | 1 | 0.971014 |
| PTPRZ1 AND SLCO1C1 | 0.9375 | 1 | 0.882353 | PTPRZ1 AND SLC3A2 | 0.985294 | 1 | 0.971014 |
| PTPRZ1 AND PON2 | 0.9375 | 1 | 0.882353 | PTPRZ1 AND MPPE1 | 0.977778 | 1 | 0.956522 |
| PTPRZ1 AND LRRN3 | 0.9375 | 1 | 0.882353 | PTPRZ1 AND SLC5A3 | 0.985294 | 1 | 0.971014 |
| PTPRZ1 AND SLC35F2 | 0.903226 | 1 | 0.823529 | PTPRZ1 AND SLC20A1 | 0.992701 | 1 | 0.985507 |
| PTPRZ1 AND PPIB | 0.9375 | 1 | 0.882353 | PTPRZ1 AND BMPR1A | 0.970149 | 1 | 0.942029 |
| PTPRZ1 AND MS4A12 | 0.903226 | 1 | 0.823529 | PTPRZ1 AND BNIP2 | 0.992701 | 1 | 0.985507 |

FIG. 6 (cont.)

| Antigen Pair Logic | F1 | Precision | Recall | Antigen Pair Logic | F1 | Precision | Recall |
|---|---|---|---|---|---|---|---|
| PTPRZ1 AND LPPR1 | 0.903226 | 1 | 0.823529 | PTPRZ1 AND SOAT1 | 0.977778 | 1 | 0.956522 |
| PTPRZ1 AND CMTM6 | 0.9375 | 1 | 0.882353 | PTPRZ1 AND SSR2 | 0.970149 | 1 | 0.942029 |
| PTPRZ1 AND TMEM248 | 0.903226 | 1 | 0.823529 | PTPRZ1 AND SSR3 | 0.977778 | 1 | 0.956522 |
| PTPRZ1 AND TMEM45A | 0.9375 | 1 | 0.882353 | PTPRZ1 AND HSPA13 | 0.992701 | 1 | 0.985507 |
| PTPRZ1 AND TMEM33 | 0.903226 | 1 | 0.823529 | PTPRZ1 AND STX4 | 0.970149 | 1 | 0.942029 |
| PTPRZ1 AND SEC61A2 | 0.903226 | 1 | 0.823529 | PTPRZ1 AND SURF4 | 0.992701 | 1 | 0.985507 |
| PTPRZ1 AND NAT10 | 0.903226 | 1 | 0.823529 | PTPRZ1 AND VAMP7 | 0.970149 | 1 | 0.942029 |
| PTPRZ1 AND TMEM100 | 0.9375 | 1 | 0.882353 | PTPRZ1 AND TAPBP | 0.985294 | 1 | 0.971014 |
| PTPRZ1 AND LRRC59 | 0.9375 | 1 | 0.882353 | PTPRZ1 AND TGFBI | 0.977778 | 1 | 0.956522 |
| PTPRZ1 AND CHST12 | 0.903226 | 1 | 0.823529 | PTPRZ1 AND TMPO | 0.992701 | 1 | 0.985507 |
| PTPRZ1 AND IL17RB | 0.9375 | 1 | 0.882353 | PTPRZ1 AND WRB | 0.992701 | 1 | 0.985507 |
| PTPRZ1 AND SLC30A6 | 0.903226 | 1 | 0.823529 | PTPRZ1 AND PTTG1IP | 0.992701 | 1 | 0.985507 |
| PTPRZ1 AND NDC1 | 0.9375 | 1 | 0.882353 | PTPRZ1 AND ZNF7 | 0.977778 | 1 | 0.956522 |
| PTPRZ1 AND SAYSD1 | 0.903226 | 1 | 0.823529 | PTPRZ1 AND TMEM50B | 0.992701 | 1 | 0.985507 |
| PTPRZ1 AND PAG1 | 0.9375 | 1 | 0.882353 | PTPRZ1 AND ZNF138 | 0.977778 | 1 | 0.956522 |
| PTPRZ1 AND TMEM165 | 0.9375 | 1 | 0.882353 | PTPRZ1 AND TVP23A | 0.970149 | 1 | 0.942029 |
| PTPRZ1 AND AXL | 0.903226 | 1 | 0.823529 | PTPRZ1 AND DDR1 | 0.977778 | 1 | 0.956522 |
| PTPRZ1 AND PCDHB9 | 0.9375 | 1 | 0.882353 | PTPRZ1 AND PXDN | 0.970149 | 1 | 0.942029 |
| PTPRZ1 AND PROS1 | 0.903226 | 1 | 0.823529 | PTPRZ1 AND ALG8 | 0.985294 | 1 | 0.971014 |
| PTPRZ1 AND PMEPA1 | 0.903226 | 1 | 0.823529 | PTPRZ1 AND REEP5 | 0.992701 | 1 | 0.985507 |
| PTPRZ1 AND ACKR3 | 0.903226 | 1 | 0.823529 | PTPRZ1 AND ATG9A | 0.970149 | 1 | 0.942029 |
| PTPRZ1 AND PNPLA2 | 0.9375 | 1 | 0.882353 | PTPRZ1 AND APOO | 0.992701 | 1 | 0.985507 |
| PTPRZ1 AND PTCH1 | 0.9375 | 1 | 0.882353 | PTPRZ1 AND DERL1 | 0.977778 | 1 | 0.956522 |
| PTPRZ1 AND PTGS1 | 0.903226 | 1 | 0.823529 | PTPRZ1 AND MFSD11 | 0.992701 | 1 | 0.985507 |
| PTPRZ1 AND GRAMD1B | 0.9375 | 1 | 0.882353 | PTPRZ1 AND TMEM243 | 0.970149 | 1 | 0.942029 |
| PTPRZ1 AND HEG1 | 0.9375 | 1 | 0.882353 | PTPRZ1 AND TMEM43 | 0.992701 | 1 | 0.985507 |
| PTPRZ1 AND GPR158 | 0.9375 | 1 | 0.882353 | PTPRZ1 AND C17orf62 | 0.985294 | 1 | 0.971014 |
| PTPRZ1 AND SERINC1 | 0.9375 | 1 | 0.882353 | PTPRZ1 AND ATP13A3 | 0.985294 | 1 | 0.971014 |
| PTPRZ1 AND LRFN1 | 0.903226 | 1 | 0.823529 | PTPRZ1 AND TTC13 | 0.992701 | 1 | 0.985507 |
| PTPRZ1 AND PCDHB16 | 0.903226 | 1 | 0.823529 | PTPRZ1 AND ADIPOR2 | 0.985294 | 1 | 0.971014 |
| PTPRZ1 AND PTPRA | 0.9375 | 1 | 0.882353 | PTPRZ1 AND RHBDF2 | 0.970149 | 1 | 0.942029 |
| PTPRZ1 AND PTPRC | 0.903226 | 1 | 0.823529 | PTPRZ1 AND TMEM204 | 0.985294 | 1 | 0.971014 |
| PTPRZ1 AND PTPRO | 0.903226 | 1 | 0.823529 | PTPRZ1 AND MANEA | 0.970149 | 1 | 0.942029 |
| PTPRZ1 AND MS4A7 | 0.9375 | 1 | 0.882353 | PTPRZ1 AND TXNDC15 | 0.985294 | 1 | 0.971014 |
| PTPRZ1 AND RARRES3 | 0.903226 | 1 | 0.823529 | PTPRZ1 AND ST7 | 0.992701 | 1 | 0.985507 |
| PTPRZ1 AND RNASE4 | 0.903226 | 1 | 0.823529 | PTPRZ1 AND UXS1 | 0.985294 | 1 | 0.971014 |
| PTPRZ1 AND RNASE6 | 0.903226 | 1 | 0.823529 | PTPRZ1 AND ORAI2 | 0.977778 | 1 | 0.956522 |
| PTPRZ1 AND KCNK15 | 0.903226 | 1 | 0.823529 | PTPRZ1 AND CD276 | 0.985294 | 1 | 0.971014 |
| PTPRZ1 AND RPN2 | 0.903226 | 1 | 0.823529 | PTPRZ1 AND MLF2 | 0.977778 | 1 | 0.956522 |
| PTPRZ1 AND RYK | 0.903226 | 1 | 0.823529 | PTPRZ1 AND CLPTM1L | 0.992701 | 1 | 0.985507 |
| PTPRZ1 AND SORT1 | 0.903226 | 1 | 0.823529 | PTPRZ1 AND SGPP1 | 0.977778 | 1 | 0.956522 |
| PTPRZ1 AND SCD | 0.903226 | 1 | 0.823529 | PTPRZ1 AND TMX1 | 0.985294 | 1 | 0.971014 |
| PTPRZ1 AND SCN1A | 0.903226 | 1 | 0.823529 | PTPRZ1 AND YIPF5 | 0.992701 | 1 | 0.985507 |
| PTPRZ1 AND CCL4 | 0.903226 | 1 | 0.823529 | PTPRZ1 AND APOLD1 | 0.977778 | 1 | 0.956522 |
| PTPRZ1 AND THADA | 0.903226 | 1 | 0.823529 | PTPRZ1 AND NIPA2 | 0.977778 | 1 | 0.956522 |
| PTPRZ1 AND MS4A6A | 0.903226 | 1 | 0.823529 | PTPRZ1 AND CANX | 0.970149 | 1 | 0.942029 |
| PTPRZ1 AND FNDC3B | 0.903226 | 1 | 0.823529 | PTPRZ1 AND CAPZA2 | 0.970149 | 1 | 0.942029 |
| PTPRZ1 AND FNDC4 | 0.903226 | 1 | 0.823529 | PTPRZ1 AND DDX59 | 0.992701 | 1 | 0.985507 |
| PTPRZ1 AND BMP2 | 0.903226 | 1 | 0.823529 | PTPRZ1 AND ARMC10 | 0.977778 | 1 | 0.956522 |
| PTPRZ1 AND SLC2A3 | 0.9375 | 1 | 0.882353 | PTPRZ1 AND TM2D2 | 0.985294 | 1 | 0.971014 |
| PTPRZ1 AND SLC3A2 | 0.9375 | 1 | 0.882353 | PTPRZ1 AND STARD3NL | 0.992701 | 1 | 0.985507 |
| PTPRZ1 AND SLC4A2 | 0.9375 | 1 | 0.882353 | PTPRZ1 AND SPNS1 | 0.977778 | 1 | 0.956522 |
| PTPRZ1 AND BMPR1A | 0.903226 | 1 | 0.823529 | PTPRZ1 AND ITFG3 | 0.985294 | 1 | 0.971014 |
| PTPRZ1 AND SLC22A4 | 0.903226 | 1 | 0.823529 | PTPRZ1 AND ANTXR1 | 0.977778 | 1 | 0.956522 |

FIG. 6 (cont.)

| Antigen Pair Logic | F1 | Precision | Recall |
|---|---|---|---|
| PTPRZ1 AND BMPR1B | 0.9375 | 1 | 0.882353 |
| PTPRZ1 AND SOAT1 | 0.9375 | 1 | 0.882353 |
| PTPRZ1 AND SPAM1 | 0.903226 | 1 | 0.823529 |
| PTPRZ1 AND BRCA1 | 0.903226 | 1 | 0.823529 |
| PTPRZ1 AND HSPA13 | 0.9375 | 1 | 0.882353 |
| PTPRZ1 AND BST2 | 0.9375 | 1 | 0.882353 |
| PTPRZ1 AND TEK | 0.9375 | 1 | 0.882353 |
| PTPRZ1 AND TGFBR2 | 0.903226 | 1 | 0.823529 |
| PTPRZ1 AND TLR2 | 0.903226 | 1 | 0.823529 |
| PTPRZ1 AND TSPAN6 | 0.903226 | 1 | 0.823529 |
| PTPRZ1 AND C1QB | 0.903226 | 1 | 0.823529 |
| PTPRZ1 AND C3AR1 | 0.9375 | 1 | 0.882353 |
| PTPRZ1 AND TYROBP | 0.9375 | 1 | 0.882353 |
| PTPRZ1 AND VCAM1 | 0.9375 | 1 | 0.882353 |
| PTPRZ1 AND WNT11 | 0.9375 | 1 | 0.882353 |
| PTPRZ1 AND RELL1 | 0.9375 | 1 | 0.882353 |
| PTPRZ1 AND LAPTM5 | 0.9375 | 1 | 0.882353 |
| PTPRZ1 AND DDR1 | 0.903226 | 1 | 0.823529 |
| PTPRZ1 AND PXDN | 0.903226 | 1 | 0.823529 |
| PTPRZ1 AND RNF103 | 0.9375 | 1 | 0.882353 |
| PTPRZ1 AND SCG2 | 0.903226 | 1 | 0.823529 |
| PTPRZ1 AND ALG8 | 0.903226 | 1 | 0.823529 |
| PTPRZ1 AND SMIM7 | 0.903226 | 1 | 0.823529 |
| PTPRZ1 AND MUL1 | 0.9375 | 1 | 0.882353 |
| PTPRZ1 AND GAL3ST4 | 0.9375 | 1 | 0.882353 |
| PTPRZ1 AND MANEA | 0.9375 | 1 | 0.882353 |
| PTPRZ1 AND CYBRD1 | 0.903226 | 1 | 0.823529 |
| PTPRZ1 AND SYNDIG1 | 0.903226 | 1 | 0.823529 |
| PTPRZ1 AND SEMA6D | 0.903226 | 1 | 0.823529 |
| PTPRZ1 AND LRRTM4 | 0.9375 | 1 | 0.882353 |
| PTPRZ1 AND SLC2A10 | 0.903226 | 1 | 0.823529 |
| PTPRZ1 AND TMX1 | 0.903226 | 1 | 0.823529 |
| PTPRZ1 AND VWA9 | 0.9375 | 1 | 0.882353 |
| PTPRZ1 AND LMAN2L | 0.903226 | 1 | 0.823529 |
| PTPRZ1 AND APOLD1 | 0.9375 | 1 | 0.882353 |
| PTPRZ1 AND TMEM163 | 0.903226 | 1 | 0.823529 |
| PTPRZ1 AND NETO2 | 0.9375 | 1 | 0.882353 |
| PTPRZ1 AND KLRC4 | 0.903226 | 1 | 0.823529 |
| PTPRZ1 AND FZD7 | 0.9375 | 1 | 0.882353 |
| PTPRZ1 AND FZD8 | 0.9375 | 1 | 0.882353 |
| PTPRZ1 AND EMC6 | 0.9375 | 1 | 0.882353 |
| PTPRZ1 AND L3MBTL2 | 0.9375 | 1 | 0.882353 |
| PTPRZ1 AND OR1A1 | 0.9375 | 1 | 0.882353 |
| PTPRZ1 AND TMEM120A | 0.9375 | 1 | 0.882353 |
| PTPRZ1 AND TMEM133 | 0.903226 | 1 | 0.823529 |
| PTPRZ1 AND B3GNT5 | 0.903226 | 1 | 0.823529 |
| PTPRZ1 AND ZNF559 | 0.9375 | 1 | 0.882353 |
| PTPRZ1 AND TPST1 | 0.903226 | 1 | 0.823529 |
| PTPRZ1 AND MGARP | 0.903226 | 1 | 0.823529 |
| PTPRZ1 AND DISP1 | 0.903226 | 1 | 0.823529 |
| PTPRZ1 AND FRMD5 | 0.9375 | 1 | 0.882353 |
| PTPRZ1 AND VAMP8 | 0.903226 | 1 | 0.823529 |
| PTPRZ1 AND ADAM23 | 0.903226 | 1 | 0.823529 |
| PTPRZ1 AND PKD2L1 | 0.9375 | 1 | 0.882353 |

| Antigen Pair Logic | F1 | Precision | Recall |
|---|---|---|---|
| PTPRZ1 AND FAR1 | 0.985294 | 1 | 0.971014 |
| PTPRZ1 AND TMEM126A | 0.977778 | 1 | 0.956522 |
| PTPRZ1 AND SLC37A3 | 0.977778 | 1 | 0.956522 |
| PTPRZ1 AND JAGN1 | 0.977778 | 1 | 0.956522 |
| PTPRZ1 AND ZNF559 | 0.977778 | 1 | 0.956522 |
| PTPRZ1 AND HIATL1 | 0.985294 | 1 | 0.971014 |
| PTPRZ1 AND SLC35B4 | 0.977778 | 1 | 0.956522 |
| PTPRZ1 AND CIRH1A | 0.985294 | 1 | 0.971014 |
| PTPRZ1 AND COX14 | 0.985294 | 1 | 0.971014 |
| PTPRZ1 AND TMEM128 | 0.977778 | 1 | 0.956522 |
| PTPRZ1 AND TMEM60 | 0.970149 | 1 | 0.942029 |
| PTPRZ1 AND DEGS1 | 0.992701 | 1 | 0.985507 |
| PTPRZ1 AND CAV1 | 0.977778 | 1 | 0.956522 |
| PTPRZ1 AND PPAP2A | 0.977778 | 1 | 0.956522 |
| PTPRZ1 AND VAMP8 | 0.977778 | 1 | 0.956522 |
| PTPRZ1 AND B4GALT4 | 0.970149 | 1 | 0.942029 |
| PTPRZ1 AND GPAA1 | 0.977778 | 1 | 0.956522 |
| PTPRZ1 AND CDS2 | 0.970149 | 1 | 0.942029 |
| PTPRZ1 AND CD164 | 0.985294 | 1 | 0.971014 |
| PTPRZ1 AND PEX11B | 0.985294 | 1 | 0.971014 |
| PTPRZ1 AND ATP6V0E1 | 0.977778 | 1 | 0.956522 |
| PTPRZ1 AND PKD2L1 | 0.992701 | 1 | 0.985507 |
| PTPRZ1 AND TMEM263 | 0.970149 | 1 | 0.942029 |
| PTPRZ1 AND CEP95 | 0.985294 | 1 | 0.971014 |
| PTPRZ1 AND SLC39A13 | 0.985294 | 1 | 0.971014 |
| PTPRZ1 AND AIFM1 | 0.985294 | 1 | 0.971014 |
| PTPRZ1 AND XPR1 | 0.970149 | 1 | 0.942029 |
| PTPRZ1 AND MTDH | 0.977778 | 1 | 0.956522 |
| PTPRZ1 AND G6PC3 | 0.985294 | 1 | 0.971014 |
| PTPRZ1 AND DTD1 | 0.970149 | 1 | 0.942029 |
| PTPRZ1 AND ORAI3 | 0.970149 | 1 | 0.942029 |
| PTPRZ1 AND PIGM | 0.992701 | 1 | 0.985507 |
| PTPRZ1 AND GTF3C3 | 0.977778 | 1 | 0.956522 |
| PTPRZ1 AND B4GALT5 | 0.985294 | 1 | 0.971014 |
| PTPRZ1 AND SFXN1 | 0.977778 | 1 | 0.956522 |
| PTPRZ1 AND TMEM203 | 0.985294 | 1 | 0.971014 |
| PTPRZ1 AND CDYL | 0.977778 | 1 | 0.956522 |
| PTPRZ1 AND STX8 | 0.970149 | 1 | 0.942029 |
| PTPRZ1 AND CHST10 | 0.970149 | 1 | 0.942029 |
| PTPRZ1 AND EEF1E1 | 0.985294 | 1 | 0.971014 |
| PTPRZ1 AND EI24 | 0.985294 | 1 | 0.971014 |
| PTPRZ1 AND ATP5J2 | 0.992701 | 1 | 0.985507 |
| PTPRZ1 AND PDIA4 | 0.985294 | 1 | 0.971014 |
| PTPRZ1 AND CD63 | 0.992701 | 1 | 0.985507 |
| PTPRZ1 AND HERPUD1 | 0.985294 | 1 | 0.971014 |
| PTPRZ1 AND LAPTM4A | 0.992701 | 1 | 0.985507 |
| PTPRZ1 AND CD81 | 0.985294 | 1 | 0.971014 |
| PTPRZ1 AND SUSD6 | 0.977778 | 1 | 0.956522 |
| PTPRZ1 AND ADGRE5 | 0.992701 | 1 | 0.985507 |
| PTPRZ1 AND PTDSS1 | 0.992701 | 1 | 0.985507 |
| PTPRZ1 AND TOMM70A | 0.977778 | 1 | 0.956522 |
| PTPRZ1 AND HELZ | 0.977778 | 1 | 0.956522 |
| CNTNAP1 AND WRB | 0.970149 | 1 | 0.942029 |
| CHST10 AND CD63 | 0.970149 | 1 | 0.942029 |

FIG. 6 (cont.)

| Antigen Pair Logic | F1 | Precision | Recall |
|---|---|---|---|
| PTPRZ1 AND SLC7A7 | 0.903226 | 1 | 0.823529 |
| PTPRZ1 AND SLC7A6 | 0.9375 | 1 | 0.882353 |
| PTPRZ1 AND AIFM1 | 0.903226 | 1 | 0.823529 |
| PTPRZ1 AND PXYLP1 | 0.903226 | 1 | 0.823529 |
| PTPRZ1 AND TIMM50 | 0.903226 | 1 | 0.823529 |
| PTPRZ1 AND CD83 | 0.903226 | 1 | 0.823529 |
| PTPRZ1 AND PIGM | 0.903226 | 1 | 0.823529 |
| PTPRZ1 AND B4GALT5 | 0.903226 | 1 | 0.823529 |
| PTPRZ1 AND TTYH2 | 0.903226 | 1 | 0.823529 |
| PTPRZ1 AND SFXN5 | 0.903226 | 1 | 0.823529 |
| PTPRZ1 AND ABCG2 | 0.9375 | 1 | 0.882353 |
| PTPRZ1 AND EIF2AK3 | 0.9375 | 1 | 0.882353 |
| PTPRZ1 AND SLC4A8 | 0.9375 | 1 | 0.882353 |
| PTPRZ1 AND ENTPD1 | 0.903226 | 1 | 0.823529 |
| PTPRZ1 AND SLC25A44 | 0.903226 | 1 | 0.823529 |
| PTPRZ1 AND CD69 | 0.903226 | 1 | 0.823529 |
| PTPRZ1 AND CD70 | 0.9375 | 1 | 0.882353 |
| PTPRZ1 AND MLEC | 0.903226 | 1 | 0.823529 |
| PTPRZ1 AND SUSD6 | 0.903226 | 1 | 0.823529 |
| PTPRZ1 AND SV2A | 0.9375 | 1 | 0.882353 |
| PTPRZ1 AND DGCR2 | 0.9375 | 1 | 0.882353 |
| Glioma (Glioma) | | | |
| PTPRZ1 | 0.985507 | 0.985507 | 0.985507 |
| NLGN1 | 0.917293 | 0.953125 | 0.884058 |
| SCRG1 | 0.909091 | 0.878378 | 0.942029 |
| PRAF2 | 0.905109 | 0.911765 | 0.898551 |
| SYT11 | 0.951049 | 0.918919 | 0.985507 |
| AGPAT5 | 0.905109 | 0.911765 | 0.898551 |
| CHST10 | 0.915493 | 0.890411 | 0.942029 |
| TPST1 | 0.917293 | 0.953125 | 0.884058 |
| PRAF2 AND PRAF2 | 0.905109 | 0.911765 | 0.898551 |
| SYT11 AND TNFRSF17 | 0.943662 | 0.917808 | 0.971014 |
| SCRG1 AND TNFRSF17 | 0.907801 | 0.888889 | 0.927536 |
| TPST1 AND TPST1 | 0.917293 | 0.953125 | 0.884058 |
| NLGN1 AND NLGN1 | 0.917293 | 0.953125 | 0.884058 |
| XPR1 AND FOLH1 | 0.909091 | 0.952381 | 0.869565 |
| TPST1 AND TPST1 | 0.917293 | 0.953125 | 0.884058 |
| AGPAT5 AND FOLH1 | 0.905109 | 0.911765 | 0.898551 |
| PRAF2 AND PRAF2 | 0.905109 | 0.911765 | 0.898551 |
| SYT11 AND CD44 | 0.928571 | 0.915493 | 0.942029 |
| SCRG1 AND CD44 | 0.909091 | 0.878378 | 0.942029 |
| TPST1 AND TPST1 | 0.917293 | 0.953125 | 0.884058 |
| CHST10 AND CD44 | 0.925373 | 0.953846 | 0.898551 |
| PTPRZ1 AND CD44 | 0.985507 | 0.985507 | 0.985507 |
| NLGN1 AND NLGN1 | 0.917293 | 0.953125 | 0.884058 |
| PRAF2 AND PRAF2 | 0.905109 | 0.911765 | 0.898551 |
| SYT11 AND WT1 | 0.920863 | 0.914286 | 0.927536 |
| SCRG1 AND SCRG1 | 0.909091 | 0.878378 | 0.942029 |
| TPST1 AND TPST1 | 0.917293 | 0.953125 | 0.884058 |
| AGPAT5 AND WT1 | 0.905109 | 0.911765 | 0.898551 |
| PTPRZ1 AND WT1 | 0.985507 | 0.985507 | 0.985507 |
| NLGN1 AND NLGN1 | 0.917293 | 0.953125 | 0.884058 |
| ITGAV AND CD33 | 0.929577 | 0.90411 | 0.956522 |
| PRAF2 AND PRAF2 | 0.905109 | 0.911765 | 0.898551 |

| Antigen Pair Logic | F1 | Precision | Recall |
|---|---|---|---|
| CHST10 AND LAPTM4A | 0.970149 | 1 | 0.942029 |
| Carcinoma, Pancreatic Ductal (Pancreas) | | | |
| TM4SF4 AND GJA1 | 0.9 | 1 | 0.818182 |
| CTRB2 AND NPTN | 0.9 | 1 | 0.818182 |
| CTRB2 AND RTN4 | 0.9 | 1 | 0.818182 |
| CTRB2 AND SDCBP | 0.9 | 1 | 0.818182 |
| TM4SF4 AND CD63 | 0.9 | 1 | 0.818182 |
| Melanoma (Melanoma) | | | |
| MLANA | 1 | 1 | 1 |
| PMEL | 0.952381 | 1 | 0.909091 |
| MLANA | 1 | 1 | 1 |
| TMEM147 | 0.9 | 1 | 0.818182 |
| CIRH1A | 0.952381 | 1 | 0.909091 |
| ROMO1 | 0.952381 | 1 | 0.909091 |
| MANBAL | 0.952381 | 1 | 0.909091 |
| FDPS | 1 | 1 | 1 |
| SFXN3 | 0.952381 | 1 | 0.909091 |
| OS9 | 0.952381 | 1 | 0.909091 |
| ERGIC3 | 0.9 | 1 | 0.818182 |
| TMEM138 | 0.952381 | 1 | 0.909091 |
| OS9 AND OS9 | 0.9 | 1 | 0.818182 |
| KIAA1549L AND DBI | 0.9 | 1 | 0.818182 |
| MLANA AND MLANA | 1 | 1 | 1 |
| TMED3 AND DBI | 0.9 | 1 | 0.818182 |
| GPR19 AND DBI | 0.9 | 1 | 0.818182 |
| BNIP1 AND DBI | 0.909091 | 0.909091 | 0.909091 |
| MANBAL AND DBI | 0.952381 | 1 | 0.909091 |
| TMEM138 AND DBI | 0.9 | 1 | 0.818182 |
| NPC1 AND DBI | 0.952381 | 1 | 0.909091 |
| CTSA AND DBI | 0.9 | 1 | 0.818182 |
| ADIPOR2 AND DBI | 0.9 | 1 | 0.818182 |
| SLC5A6 AND DBI | 0.952381 | 1 | 0.909091 |
| MC1R AND DBI | 0.9 | 1 | 0.818182 |
| TMEM147 AND TMEM147 | 0.9 | 1 | 0.818182 |
| EXT1 AND DBI | 0.909091 | 0.909091 | 0.909091 |
| TNFSF9 AND DBI | 0.952381 | 1 | 0.909091 |
| C11orf24 AND DBI | 0.9 | 1 | 0.818182 |
| BCAP31 AND DBI | 0.952381 | 1 | 0.909091 |
| FDPS AND DBI | 0.952381 | 1 | 0.909091 |
| PNKD AND DBI | 0.952381 | 1 | 0.909091 |
| NAT14 AND DBI | 0.9 | 1 | 0.818182 |
| MLANA AND BNIP3L | 1 | 1 | 1 |
| TMEM138 AND TMEM138 | 0.952381 | 1 | 0.909091 |
| DENND5A AND ENPP2 | 0.9 | 1 | 0.818182 |
| MLANA AND MLANA | 1 | 1 | 1 |
| GPR137B AND ENPP2 | 0.956522 | 0.916667 | 1 |
| CIRH1A AND ENPP2 | 0.952381 | 1 | 0.909091 |
| AUP1 AND ENPP2 | 1 | 1 | 1 |
| C14orf2 AND ENPP2 | 0.9 | 1 | 0.818182 |
| TMEM147 AND ENPP2 | 0.9 | 1 | 0.818182 |
| MLANA AND POLG2 | 0.9 | 1 | 0.818182 |
| CIRH1A AND POLG2 | 0.952381 | 1 | 0.909091 |
| OS9 AND OS9 | 0.9 | 1 | 0.818182 |
| TMED3 AND DDB2 | 0.9 | 1 | 0.818182 |

FIG. 6 (cont.)

| Antigen Pair Logic | F1 | Precision | Recall | Antigen Pair Logic | F1 | Precision | Recall |
|---|---|---|---|---|---|---|---|
| SYT11 AND CD33 | 0.951049 | 0.918919 | 0.985507 | MANBAL AND DDB2 | 0.952381 | 1 | 0.909091 |
| SCRG1 AND CD33 | 0.909091 | 0.878378 | 0.942029 | APMAP AND DDB2 | 0.909091 | 0.909091 | 0.909091 |
| TPST1 AND TPST1 | 0.917293 | 0.953125 | 0.884058 | TMEM138 AND DDB2 | 0.952381 | 1 | 0.909091 |
| CHST10 AND CD33 | 0.9 | 0.887324 | 0.913043 | EDNRB AND DDB2 | 0.9 | 1 | 0.818182 |
| PTPRZ1 AND CD33 | 0.985507 | 0.985507 | 0.985507 | TMEM147 AND TMEM147 | 0.9 | 1 | 0.818182 |
| NLGN1 AND NLGN1 | 0.917293 | 0.953125 | 0.884058 | BCAP31 AND DDB2 | 0.952381 | 1 | 0.909091 |
| SYT11 AND ST8SIA1 | 0.951049 | 0.918919 | 0.985507 | FDPS AND DDB2 | 1 | 1 | 1 |
| SCRG1 AND ST8SIA1 | 0.909091 | 0.878378 | 0.942029 | ROMO1 AND DDB2 | 0.952381 | 1 | 0.909091 |
| PTPRZ1 AND ST8SIA1 | 0.985507 | 0.985507 | 0.985507 | STARD3NL AND DDB2 | 0.9 | 1 | 0.818182 |
| NCAM1 AND TMEM14C | 0.900763 | 0.951613 | 0.855072 | MLANA AND BSG | 1 | 1 | 1 |
| NCAM1 AND WDR83OS | 0.903704 | 0.924242 | 0.884058 | TMEM147 AND TMEM147 | 0.9 | 1 | 0.818182 |
| NLGN1 AND NLGN1 | 0.917293 | 0.953125 | 0.884058 | MLANA AND CDKN3 | 1 | 1 | 1 |
| NCAM1 AND PTTG1IP | 0.907692 | 0.967213 | 0.855072 | NDUFA1 AND CDKN3 | 0.9 | 1 | 0.818182 |
| NCAM1 AND ITGAV | 0.914729 | 0.983333 | 0.855072 | STARD3NL AND CDKN3 | 0.9 | 1 | 0.818182 |
| NCAM1 AND TMX1 | 0.903704 | 0.924242 | 0.884058 | OS9 AND OS9 | 0.9 | 1 | 0.818182 |
| NCAM1 AND SERP1 | 0.903704 | 0.924242 | 0.884058 | SFXN3 AND CSH1 | 0.9 | 1 | 0.818182 |
| NCAM1 AND UBXN8 | 0.905109 | 0.911765 | 0.898551 | TMEM138 AND TMEM138 | 0.952381 | 1 | 0.909091 |
| NCAM1 AND SLC38A9 | 0.903704 | 0.924242 | 0.884058 | OS9 AND OS9 | 0.9 | 1 | 0.818182 |
| PON2 AND NCAM1 | 0.918519 | 0.939394 | 0.898551 | TMEM138 AND GNB2 | 0.9 | 1 | 0.818182 |
| XPR1 AND NCAM1 | 0.909091 | 0.952381 | 0.869565 | CIRH1A AND GNB2 | 0.952381 | 1 | 0.909091 |
| NCAM1 AND GOLM1 | 0.916031 | 0.967742 | 0.869565 | TMEM147 AND TMEM147 | 0.9 | 1 | 0.818182 |
| NCAM1 AND WRB | 0.917293 | 0.953125 | 0.884058 | MLANA AND CSF3R | 1 | 1 | 1 |
| NCAM1 AND SELK | 0.916031 | 0.967742 | 0.869565 | CIRH1A AND CSF3R | 0.952381 | 1 | 0.909091 |
| NCAM1 AND GALNT1 | 0.911765 | 0.925373 | 0.898551 | TMEM147 AND CSF3R | 0.9 | 1 | 0.818182 |
| NCAM1 AND ATRAID | 0.903704 | 0.924242 | 0.884058 | DENND5A AND BMPR1A | 0.9 | 1 | 0.818182 |
| NCAM1 AND ATP5F1 | 0.903704 | 0.924242 | 0.884058 | SFXN3 AND BMPR1A | 0.952381 | 1 | 0.909091 |
| NCAM1 AND SLC30A5 | 0.903704 | 0.924242 | 0.884058 | GPR137B AND BMPR1A | 0.909091 | 0.909091 | 0.909091 |
| FJX1 AND NCAM1 | 0.905109 | 0.911765 | 0.898551 | OXA1L AND BMPR1A | 0.952381 | 1 | 0.909091 |
| SYT11 AND SYT11 | 0.951049 | 0.918919 | 0.985507 | PARL AND BMPR1A | 0.952381 | 1 | 0.909091 |
| SCRG1 AND SCRG1 | 0.909091 | 0.878378 | 0.942029 | TMEM138 AND BMPR1A | 0.9 | 1 | 0.818182 |
| NCAM1 AND SPCS1 | 0.907692 | 0.967213 | 0.855072 | DERL2 AND BMPR1A | 0.9 | 1 | 0.818182 |
| NCAM1 AND JTB | 0.907692 | 0.967213 | 0.855072 | AUP1 AND BMPR1A | 0.952381 | 1 | 0.909091 |
| NCAM1 AND UBA2 | 0.932331 | 0.96875 | 0.898551 | DAD1 AND BMPR1A | 0.9 | 1 | 0.818182 |
| NCAM1 AND E2F5 | 0.903704 | 0.924242 | 0.884058 | BCAP31 AND BCAP31 | 0.952381 | 1 | 0.909091 |
| TPST1 AND NCAM1 | 0.917293 | 0.953125 | 0.884058 | STARD3NL AND BMPR1A | 0.9 | 1 | 0.818182 |
| AGPAT5 AND NCAM1 | 0.918519 | 0.939394 | 0.898551 | TMEM147 AND TMEM147 | 0.9 | 1 | 0.818182 |
| NCAM1 AND SEC11A | 0.902256 | 0.9375 | 0.869565 | BCAP31 AND BCAP31 | 0.952381 | 1 | 0.909091 |
| NCAM1 AND TMEM69 | 0.911765 | 0.925373 | 0.898551 | DENND5A AND DST | 0.9 | 1 | 0.818182 |
| CHST10 AND NCAM1 | 0.915493 | 0.890411 | 0.942029 | GPR137B AND DST | 0.909091 | 0.909091 | 0.909091 |
| NCAM1 AND IER3IP1 | 0.909091 | 0.952381 | 0.869565 | OXA1L AND DST | 0.952381 | 1 | 0.909091 |
| NCAM1 AND PIGF | 0.903704 | 0.924242 | 0.884058 | PARL AND DST | 1 | 1 | 1 |
| PTPRZ1 AND NCAM1 | 0.985507 | 0.985507 | 0.985507 | TMEM138 AND DST | 0.952381 | 1 | 0.909091 |
| NCAM1 AND CDYL | 0.900763 | 0.951613 | 0.855072 | DERL2 AND DST | 0.952381 | 1 | 0.909091 |
| NCAM1 AND NDUFA4 | 0.910448 | 0.938462 | 0.884058 | AUP1 AND DST | 1 | 1 | 1 |
| NCAM1 AND TMEM203 | 0.903704 | 0.924242 | 0.884058 | GUSB AND DST | 0.909091 | 0.909091 | 0.909091 |
| PRAF2 AND PRAF2 | 0.905109 | 0.911765 | 0.898551 | DAD1 AND DST | 0.9 | 1 | 0.818182 |
| SYT11 AND CD19 | 0.928571 | 0.915493 | 0.942029 | COX8A AND DST | 0.909091 | 0.909091 | 0.909091 |
| SCRG1 AND CD19 | 0.907801 | 0.888889 | 0.927536 | BCAP31 AND DST | 0.952381 | 1 | 0.909091 |
| TPST1 AND TPST1 | 0.917293 | 0.953125 | 0.884058 | NDUFA1 AND DST | 0.952381 | 1 | 0.909091 |
| NLGN1 AND NLGN1 | 0.917293 | 0.953125 | 0.884058 | STARD3NL AND DST | 0.9 | 1 | 0.818182 |
| PRAF2 AND PRAF2 | 0.905109 | 0.911765 | 0.898551 | OS9 AND OS9 | 0.9 | 1 | 0.818182 |
| SYT11 AND GPC3 | 0.928571 | 0.915493 | 0.942029 | TMEM138 AND TMEM138 | 0.952381 | 1 | 0.909091 |
| SCRG1 AND GPC3 | 0.901408 | 0.876712 | 0.927536 | TMEM147 AND TMEM147 | 0.9 | 1 | 0.818182 |
| TPST1 AND TPST1 | 0.917293 | 0.953125 | 0.884058 | BCAP31 AND CRYGC | 0.9 | 1 | 0.818182 |

FIG. 6 (cont.)

| Antigen Pair Logic | F1 | Precision | Recall | Antigen Pair Logic | F1 | Precision | Recall |
|---|---|---|---|---|---|---|---|
| CHST10 AND GPC3 | 0.907801 | 0.888889 | 0.927536 | ROMO1 AND CRYGC | 0.952381 | 1 | 0.909091 |
| NLGN1 AND NLGN1 | 0.917293 | 0.953125 | 0.884058 | MLANA AND DHODH | 0.952381 | 1 | 0.909091 |
| PRAF2 AND PRAF2 | 0.905109 | 0.911765 | 0.898551 | TMEM138 AND DHODH | 0.9 | 1 | 0.818182 |
| SYT11 AND SYT11 | 0.951049 | 0.918919 | 0.985507 | TMEM147 AND DHODH | 0.9 | 1 | 0.818182 |
| SCRG1 AND SCRG1 | 0.909091 | 0.878378 | 0.942029 | OS9 AND OS9 | 0.9 | 1 | 0.818182 |
| AGPAT5 AND B4GALNT1 | 0.905109 | 0.911765 | 0.898551 | MLANA AND AES | 0.9 | 1 | 0.818182 |
| CHST10 AND CD160 | 0.915493 | 0.890411 | 0.942029 | SFXN3 AND AES | 0.952381 | 1 | 0.909091 |
| NLGN1 AND ERBB2 | 0.917293 | 0.953125 | 0.884058 | MANBAL AND AES | 0.952381 | 1 | 0.909091 |
| PRAF2 AND PRAF2 | 0.905109 | 0.911765 | 0.898551 | BCAP31 AND AES | 0.9 | 1 | 0.818182 |
| SYT11 AND ERBB2 | 0.951049 | 0.918919 | 0.985507 | FDPS AND AES | 0.952381 | 1 | 0.909091 |
| SCRG1 AND ERBB2 | 0.909091 | 0.878378 | 0.942029 | ROMO1 AND AES | 0.952381 | 1 | 0.909091 |
| AGPAT5 AND ERBB2 | 0.905109 | 0.911765 | 0.898551 | MLANA AND HADH | 0.952381 | 1 | 0.909091 |
| CHST10 AND ERBB2 | 0.915493 | 0.890411 | 0.942029 | MLANA AND GPX7 | 1 | 1 | 1 |
| NLGN1 AND NLGN1 | 0.917293 | 0.953125 | 0.884058 | CIRH1A AND GPX7 | 0.952381 | 1 | 0.909091 |
| PRAF2 AND PRAF2 | 0.905109 | 0.911765 | 0.898551 | TMEM147 AND GPX7 | 0.9 | 1 | 0.818182 |
| SYT11 AND SYT11 | 0.951049 | 0.918919 | 0.985507 | OS9 AND OS9 | 0.9 | 1 | 0.818182 |
| SCRG1 AND SCRG1 | 0.909091 | 0.878378 | 0.942029 | MLANA AND MLANA | 1 | 1 | 1 |
| TPST1 AND TPST1 | 0.917293 | 0.953125 | 0.884058 | SFXN3 AND ART3 | 0.9 | 1 | 0.818182 |
| AGPAT5 AND AGPAT5 | 0.905109 | 0.911765 | 0.898551 | GPR137B AND ART3 | 0.909091 | 0.909091 | 0.909091 |
| CHST10 AND IL11RA | 0.915493 | 0.890411 | 0.942029 | OXA1L AND ART3 | 0.9 | 1 | 0.818182 |
| PRAF2 AND PRAF2 | 0.905109 | 0.911765 | 0.898551 | PARL AND ART3 | 0.952381 | 1 | 0.909091 |
| SYT11 AND PSCA | 0.943662 | 0.917808 | 0.971014 | TMEM138 AND ART3 | 0.9 | 1 | 0.818182 |
| SCRG1 AND PSCA | 0.907801 | 0.888889 | 0.927536 | ERGIC3 AND ART3 | 0.9 | 1 | 0.818182 |
| AGPAT5 AND PSCA | 0.905109 | 0.911765 | 0.898551 | DERL2 AND ART3 | 0.9 | 1 | 0.818182 |
| CHST10 AND PSCA | 0.907801 | 0.888889 | 0.927536 | AUP1 AND ART3 | 0.952381 | 1 | 0.909091 |
| NLGN1 AND NLGN1 | 0.917293 | 0.953125 | 0.884058 | TMEM147 AND TMEM147 | 0.9 | 1 | 0.818182 |
| PRAF2 AND PRAF2 | 0.905109 | 0.911765 | 0.898551 | FDPS AND ART3 | 0.952381 | 1 | 0.909091 |
| SYT11 AND MS4A1 | 0.943662 | 0.917808 | 0.971014 | ROMO1 AND ART3 | 0.9 | 1 | 0.818182 |
| SCRG1 AND MS4A1 | 0.901408 | 0.876712 | 0.927536 | OS9 AND OS9 | 0.9 | 1 | 0.818182 |
| CHST10 AND MS4A1 | 0.907801 | 0.888889 | 0.927536 | MLANA AND DDB1 | 1 | 1 | 1 |
| NLGN1 AND NLGN1 | 0.917293 | 0.953125 | 0.884058 | SFXN3 AND DDB1 | 0.9 | 1 | 0.818182 |
| PRAF2 AND PRAF2 | 0.905109 | 0.911765 | 0.898551 | OXA1L AND DDB1 | 0.9 | 1 | 0.818182 |
| SYT11 AND IL13RA2 | 0.951049 | 0.918919 | 0.985507 | PARL AND DDB1 | 0.9 | 1 | 0.818182 |
| SCRG1 AND IL13RA2 | 0.909091 | 0.878378 | 0.942029 | COX7A2L AND DDB1 | 0.9 | 1 | 0.818182 |
| TPST1 AND TPST1 | 0.917293 | 0.953125 | 0.884058 | MANBAL AND DDB1 | 0.9 | 1 | 0.818182 |
| AGPAT5 AND IL13RA2 | 0.918519 | 0.939394 | 0.898551 | ERGIC3 AND DDB1 | 0.9 | 1 | 0.818182 |
| CHST10 AND IL13RA2 | 0.915493 | 0.890411 | 0.942029 | DERL2 AND DDB1 | 0.9 | 1 | 0.818182 |
| PTPRZ1 AND IL13RA2 | 0.985507 | 0.985507 | 0.985507 | AUP1 AND DDB1 | 0.9 | 1 | 0.818182 |
| NLGN1 AND NLGN1 | 0.917293 | 0.953125 | 0.884058 | TMEM147 AND TMEM147 | 0.9 | 1 | 0.818182 |
| PRAF2 AND PRAF2 | 0.905109 | 0.911765 | 0.898551 | BCAP31 AND DDB1 | 0.9 | 1 | 0.818182 |
| SYT11 AND SYT11 | 0.951049 | 0.918919 | 0.985507 | FDPS AND DDB1 | 0.9 | 1 | 0.818182 |
| SCRG1 AND SCRG1 | 0.909091 | 0.878378 | 0.942029 | ROMO1 AND DDB1 | 0.952381 | 1 | 0.909091 |
| AGPAT5 AND AGPAT5 | 0.905109 | 0.911765 | 0.898551 | OS9 AND OS9 | 0.9 | 1 | 0.818182 |
| ITGAV AND MAGEA1 | 0.914286 | 0.901408 | 0.927536 | TMEM147 AND TMEM147 | 0.9 | 1 | 0.818182 |
| PRAF2 AND PRAF2 | 0.905109 | 0.911765 | 0.898551 | DENND5A AND BMPR1B | 0.9 | 1 | 0.818182 |
| SYT11 AND MAGEA1 | 0.93617 | 0.916667 | 0.956522 | MLANA AND MLANA | 1 | 1 | 1 |
| SCRG1 AND MAGEA1 | 0.907801 | 0.888889 | 0.927536 | GPR137B AND BMPR1B | 0.909091 | 0.909091 | 0.909091 |
| TPST1 AND MAGEA1 | 0.909091 | 0.952381 | 0.869565 | PARL AND BMPR1B | 0.952381 | 1 | 0.909091 |
| CHST10 AND MAGEA1 | 0.9 | 0.887324 | 0.913043 | CIRH1A AND BMPR1B | 0.952381 | 1 | 0.909091 |
| NLGN1 AND MLANA | 0.917293 | 0.953125 | 0.884058 | DERL2 AND BMPR1B | 0.952381 | 1 | 0.909091 |
| SYT11 AND MLANA | 0.928571 | 0.915493 | 0.942029 | AUP1 AND BMPR1B | 0.952381 | 1 | 0.909091 |
| TPST1 AND TPST1 | 0.917293 | 0.953125 | 0.884058 | TMEM147 AND BMPR1B | 0.9 | 1 | 0.818182 |
| NLGN1 AND NLGN1 | 0.917293 | 0.953125 | 0.884058 | ROMO1 AND BMPR1B | 0.952381 | 1 | 0.909091 |
| PRAF2 AND PRAF2 | 0.905109 | 0.911765 | 0.898551 | MLANA AND GMFB | 1 | 1 | 1 |

FIG. 6 (cont.)

| Antigen Pair Logic | F1 | Precision | Recall | Antigen Pair Logic | F1 | Precision | Recall |
|---|---|---|---|---|---|---|---|
| SYT11 AND SYT11 | 0.951049 | 0.918919 | 0.985507 | CIRH1A AND GMFB | 0.952381 | 1 | 0.909091 |
| SCRG1 AND SCRG1 | 0.909091 | 0.878378 | 0.942029 | TMEM147 AND GMFB | 0.9 | 1 | 0.818182 |
| TPST1 AND TPST1 | 0.917293 | 0.953125 | 0.884058 | TMEM138 AND TMEM138 | 0.952381 | 1 | 0.909091 |
| CHST10 AND ERBB3 | 0.915493 | 0.890411 | 0.942029 | MLANA AND PICK1 | 0.952381 | 1 | 0.909091 |
| NLGN1 AND NLGN1 | 0.917293 | 0.953125 | 0.884058 | SFXN3 AND PICK1 | 0.952381 | 1 | 0.909091 |
| PRAF2 AND PRAF2 | 0.905109 | 0.911765 | 0.898551 | OXA1L AND PICK1 | 0.9 | 1 | 0.818182 |
| TPST1 AND ERBB4 | 0.900763 | 0.951613 | 0.855072 | PARL AND PICK1 | 0.9 | 1 | 0.818182 |
| AGPAT5 AND ERBB4 | 0.910448 | 0.938462 | 0.884058 | TMEM138 AND PICK1 | 0.9 | 1 | 0.818182 |
| PRAF2 AND PRAF2 | 0.905109 | 0.911765 | 0.898551 | AUP1 AND PICK1 | 0.9 | 1 | 0.818182 |
| SYT11 AND GPA33 | 0.943662 | 0.917808 | 0.971014 | BCAP31 AND PICK1 | 0.9 | 1 | 0.818182 |
| SCRG1 AND GPA33 | 0.901408 | 0.876712 | 0.927536 | NDUFA1 AND PICK1 | 0.9 | 1 | 0.818182 |
| TPST1 AND TPST1 | 0.917293 | 0.953125 | 0.884058 | PQLC1 AND PSMB7 | 0.9 | 1 | 0.818182 |
| CHST10 AND GPA33 | 0.907801 | 0.888889 | 0.927536 | OS9 AND OS9 | 0.9 | 1 | 0.818182 |
| NRCAM AND CD276 | 0.910448 | 0.938462 | 0.884058 | FAM3A AND PSMB7 | 0.9 | 1 | 0.818182 |
| NLGN1 AND NLGN1 | 0.917293 | 0.953125 | 0.884058 | MLANA AND PSMB7 | 1 | 1 | 1 |
| ITGAV AND CD276 | 0.942857 | 0.929577 | 0.956522 | PIGL AND PSMB7 | 0.9 | 1 | 0.818182 |
| GPM6A AND CD276 | 0.93617 | 0.916667 | 0.956522 | LARGE AND PSMB7 | 0.9 | 1 | 0.818182 |
| XPR1 AND CD276 | 0.900763 | 0.951613 | 0.855072 | GPR137B AND PSMB7 | 0.9 | 1 | 0.818182 |
| SYT11 AND CD276 | 0.943662 | 0.917808 | 0.971014 | HGSNAT AND PSMB7 | 0.9 | 1 | 0.818182 |
| SCRG1 AND CD276 | 0.914286 | 0.901408 | 0.927536 | CLCN5 AND PSMB7 | 0.952381 | 1 | 0.909091 |
| TPST1 AND TPST1 | 0.917293 | 0.953125 | 0.884058 | VANGL2 AND PSMB7 | 0.952381 | 1 | 0.909091 |
| GRIA2 AND CD276 | 0.906475 | 0.9 | 0.913043 | APMAP AND PSMB7 | 0.952381 | 1 | 0.909091 |
| AGPAT5 AND CD276 | 0.918519 | 0.939394 | 0.898551 | FAM134A AND PSMB7 | 0.952381 | 1 | 0.909091 |
| CHST10 AND CD276 | 0.934307 | 0.941176 | 0.927536 | TMEM138 AND PSMB7 | 0.9 | 1 | 0.818182 |
| PTPRZ1 AND CD276 | 0.985294 | 1 | 0.971014 | YIF1B AND PSMB7 | 0.9 | 1 | 0.818182 |
| TPST1 AND TPST1 | 0.917293 | 0.953125 | 0.884058 | TMEM184B AND PSMB7 | 0.952381 | 1 | 0.909091 |
| CHST10 AND CD22 | 0.907801 | 0.888889 | 0.927536 | SLC5A6 AND PSMB7 | 0.952381 | 1 | 0.909091 |
| NLGN1 AND NLGN1 | 0.917293 | 0.953125 | 0.884058 | PTPRS AND PSMB7 | 0.9 | 1 | 0.818182 |
| PRAF2 AND PRAF2 | 0.905109 | 0.911765 | 0.898551 | TMEM147 AND TMEM147 | 0.9 | 1 | 0.818182 |
| SYT11 AND ROR1 | 0.951049 | 0.918919 | 0.985507 | EXT1 AND PSMB7 | 0.952381 | 1 | 0.909091 |
| SCRG1 AND ROR1 | 0.909091 | 0.878378 | 0.942029 | TNFSF9 AND PSMB7 | 0.909091 | 0.909091 | 0.909091 |
| TPST1 AND TPST1 | 0.917293 | 0.953125 | 0.884058 | NDST1 AND PSMB7 | 0.952381 | 1 | 0.909091 |
| AGPAT5 AND ROR1 | 0.905109 | 0.911765 | 0.898551 | CLCC1 AND PSMB7 | 0.9 | 1 | 0.818182 |
| CHST10 AND ROR1 | 0.915493 | 0.890411 | 0.942029 | ABHD12 AND PSMB7 | 0.952381 | 1 | 0.909091 |
| NLGN1 AND NLGN1 | 0.917293 | 0.953125 | 0.884058 | FDPS AND PSMB7 | 0.952381 | 1 | 0.909091 |
| PRAF2 AND PRAF2 | 0.905109 | 0.911765 | 0.898551 | ICMT AND PSMB7 | 0.9 | 1 | 0.818182 |
| SYT11 AND CA9 | 0.943662 | 0.917808 | 0.971014 | PNKD AND PSMB7 | 0.909091 | 0.909091 | 0.909091 |
| SCRG1 AND CA9 | 0.907801 | 0.888889 | 0.927536 | PFKP AND PSMB7 | 0.9 | 1 | 0.818182 |
| TPST1 AND TPST1 | 0.917293 | 0.953125 | 0.884058 | ROMO1 AND PSMB7 | 0.952381 | 1 | 0.909091 |
| AGPAT5 AND CA9 | 0.905109 | 0.911765 | 0.898551 | GCNT2 AND PSMB7 | 0.9 | 1 | 0.818182 |
| CHST10 AND CA9 | 0.9 | 0.887324 | 0.913043 | CELSR2 AND PSMB7 | 0.952381 | 1 | 0.909091 |
| PTPRZ1 AND CA9 | 0.985507 | 0.985507 | 0.985507 | OS9 AND OS9 | 0.9 | 1 | 0.818182 |
| NLGN1 AND NLGN1 | 0.917293 | 0.953125 | 0.884058 | SFXN3 AND CSF3 | 0.952381 | 1 | 0.909091 |
| PRAF2 AND PRAF2 | 0.905109 | 0.911765 | 0.898551 | TMEM138 AND TMEM138 | 0.952381 | 1 | 0.909091 |
| SYT11 AND EPHA2 | 0.943662 | 0.917808 | 0.971014 | ERGIC3 AND CSF3 | 0.9 | 1 | 0.818182 |
| SCRG1 AND EPHA2 | 0.909091 | 0.878378 | 0.942029 | TMEM147 AND TMEM147 | 0.9 | 1 | 0.818182 |
| CHST10 AND EPHA2 | 0.907801 | 0.888889 | 0.927536 | TMEM138 AND TMEM138 | 0.952381 | 1 | 0.909091 |
| PRAF2 AND PRAF2 | 0.905109 | 0.911765 | 0.898551 | FDPS AND NAALADL1 | 1 | 1 | 1 |
| SYT11 AND TNFSF11 | 0.93617 | 0.916667 | 0.956522 | MLANA AND KCNE3 | 1 | 1 | 1 |
| SCRG1 AND TNFSF11 | 0.9 | 0.887324 | 0.913043 | FDPS AND CDH2 | 1 | 1 | 1 |
| TPST1 AND TPST1 | 0.917293 | 0.953125 | 0.884058 | MLANA AND MLANA | 1 | 1 | 1 |
| CHST10 AND TNFSF11 | 0.9 | 0.887324 | 0.913043 | MLANA AND TMEM170B | 1 | 1 | 1 |
| SYT11 AND SDC1 | 0.928571 | 0.915493 | 0.942029 | MLANA AND NEMP2 | 1 | 1 | 1 |
| PRAF2 AND PRAF2 | 0.905109 | 0.911765 | 0.898551 | MLANA AND PIGK | 1 | 1 | 1 |

FIG. 6 (cont.)

| Antigen Pair Logic | F1 | Precision | Recall | Antigen Pair Logic | F1 | Precision | Recall |
|---|---|---|---|---|---|---|---|
| SYT11 AND SYT11 | 0.951049 | 0.918919 | 0.985507 | MLANA AND TIMM23 | 1 | 1 | 1 |
| SCRG1 AND SCRG1 | 0.909091 | 0.878378 | 0.942029 | MLANA AND MLANA | 1 | 1 | 1 |
| TPST1 AND TPST1 | 0.917293 | 0.953125 | 0.884058 | MLANA AND MLANA | 1 | 1 | 1 |
| CHST10 AND TNFRSF8 | 0.9 | 0.887324 | 0.913043 | FDPS AND APELA | 1 | 1 | 1 |
| NLGN1 AND NLGN1 | 0.917293 | 0.953125 | 0.884058 | MLANA AND MLANA | 1 | 1 | 1 |
| PTPRZ1 AND CSPG4 | 0.985507 | 0.985507 | 0.985507 | MLANA AND MLANA | 1 | 1 | 1 |
| NLGN1 AND NLGN1 | 0.917293 | 0.953125 | 0.884058 | MLANA AND TMEM178B | 1 | 1 | 1 |
| PRAF2 AND PRAF2 | 0.905109 | 0.911765 | 0.898551 | MLANA AND MLANA | 1 | 1 | 1 |
| SYT11 AND CD70 | 0.93617 | 0.916667 | 0.956522 | MLANA AND 100507547? | 1 | 1 | 1 |
| TPST1 AND TPST1 | 0.917293 | 0.953125 | 0.884058 | MLANA AND MLANA | 1 | 1 | 1 |
| CHST10 AND CD70 | 0.907801 | 0.888889 | 0.927536 | MLANA AND UBA2 | 1 | 1 | 1 |
| PTPRZ1 AND CD70 | 0.962963 | 0.984848 | 0.942029 | FDPS AND ABCC5 | 1 | 1 | 1 |
| NLGN1 AND NLGN1 | 0.917293 | 0.953125 | 0.884058 | MLANA AND ABCC5 | 1 | 1 | 1 |
| SYT11 AND AXL | 0.943662 | 0.917808 | 0.971014 | NPC1 AND ABCC5 | 1 | 1 | 1 |
| SCRG1 AND SCRG1 | 0.909091 | 0.878378 | 0.942029 | FDPS AND ABCB6 | 1 | 1 | 1 |
| TPST1 AND TPST1 | 0.917293 | 0.953125 | 0.884058 | MLANA AND SCAMP2 | 1 | 1 | 1 |
| AGPAT5 AND AXL | 0.910448 | 0.938462 | 0.884058 | MLANA AND SCAMP3 | 1 | 1 | 1 |
| CHST10 AND AXL | 0.919708 | 0.926471 | 0.913043 | MLANA AND MLANA | 1 | 1 | 1 |
| PTPRZ1 AND AXL | 0.985507 | 0.985507 | 0.985507 | MLANA AND MLANA | 1 | 1 | 1 |
| SYT11 AND MUC13 | 0.951049 | 0.918919 | 0.985507 | NPC1 AND ATP9A | 1 | 1 | 1 |
| SCRG1 AND MUC13 | 0.909091 | 0.878378 | 0.942029 | MLANA AND MLANA | 1 | 1 | 1 |
| AGPAT5 AND MUC13 | 0.905109 | 0.911765 | 0.898551 | MLANA AND MLANA | 1 | 1 | 1 |
| NLGN1 AND NLGN1 | 0.917293 | 0.953125 | 0.884058 | MLANA AND MLANA | 1 | 1 | 1 |
| PRAF2 AND PRAF2 | 0.905109 | 0.911765 | 0.898551 | MLANA AND TSPAN3 | 1 | 1 | 1 |
| SYT11 AND SYT11 | 0.951049 | 0.918919 | 0.985507 | MLANA AND PREB | 1 | 1 | 1 |
| SCRG1 AND SCRG1 | 0.909091 | 0.878378 | 0.942029 | MLANA AND MLANA | 1 | 1 | 1 |
| TPST1 AND ALK | 0.900763 | 0.951613 | 0.855072 | MLANA AND MLANA | 1 | 1 | 1 |
| CHST10 AND ALK | 0.915493 | 0.890411 | 0.942029 | MLANA AND MLANA | 1 | 1 | 1 |
| PTPRZ1 AND ALK | 0.985507 | 0.985507 | 0.985507 | MLANA AND MLANA | 1 | 1 | 1 |
| SYT11 AND TNFRSF10B | 0.928571 | 0.915493 | 0.942029 | MLANA AND MLANA | 1 | 1 | 1 |
| TPST1 AND TPST1 | 0.917293 | 0.953125 | 0.884058 | MLANA AND CNIH1 | 1 | 1 | 1 |
| AGPAT5 AND AGPAT5 | 0.905109 | 0.911765 | 0.898551 | FDPS AND LHFP | 1 | 1 | 1 |
| PTPRZ1 AND TNFRSF10B | 0.985507 | 0.985507 | 0.985507 | MLANA AND LHFP | 1 | 1 | 1 |
| NLGN1 AND NLGN1 | 0.917293 | 0.953125 | 0.884058 | AUP1 AND LHFP | 1 | 1 | 1 |
| PRAF2 AND PRAF2 | 0.905109 | 0.911765 | 0.898551 | PARL AND LHFP | 1 | 1 | 1 |
| SYT11 AND SYT11 | 0.951049 | 0.918919 | 0.985507 | MLANA AND ALG3 | 1 | 1 | 1 |
| SCRG1 AND SCRG1 | 0.909091 | 0.878378 | 0.942029 | MLANA AND MLANA | 1 | 1 | 1 |
| NLGN1 AND NLGN1 | 0.917293 | 0.953125 | 0.884058 | FDPS AND CALCRL | 1 | 1 | 1 |
| PRAF2 AND PRAF2 | 0.905109 | 0.911765 | 0.898551 | MLANA AND CALCRL | 1 | 1 | 1 |
| SYT11 AND FOLR2 | 0.928571 | 0.915493 | 0.942029 | MLANA AND MLANA | 1 | 1 | 1 |
| SCRG1 AND FOLR2 | 0.909091 | 0.878378 | 0.942029 | FDPS AND TRIM13 | 1 | 1 | 1 |
| AGPAT5 AND AGPAT5 | 0.905109 | 0.911765 | 0.898551 | MLANA AND MLANA | 1 | 1 | 1 |
| PTPRZ1 AND FOLR2 | 0.985507 | 0.985507 | 0.985507 | FDPS AND KLRG1 | 1 | 1 | 1 |
| NLGN1 AND KDR | 0.917293 | 0.953125 | 0.884058 | MLANA AND MLANA | 1 | 1 | 1 |
| PRAF2 AND PRAF2 | 0.905109 | 0.911765 | 0.898551 | MLANA AND MLANA | 1 | 1 | 1 |
| SYT11 AND KDR | 0.951049 | 0.918919 | 0.985507 | MLANA AND MLANA | 1 | 1 | 1 |
| SCRG1 AND KDR | 0.909091 | 0.878378 | 0.942029 | MLANA AND STX6 | 1 | 1 | 1 |
| TPST1 AND TPST1 | 0.917293 | 0.953125 | 0.884058 | MLANA AND MLANA | 1 | 1 | 1 |
| AGPAT5 AND KDR | 0.902256 | 0.9375 | 0.869565 | AUP1 AND MSLN | 1 | 1 | 1 |
| CHST10 AND KDR | 0.907801 | 0.888889 | 0.927536 | MLANA AND MLANA | 1 | 1 | 1 |
| PTPRZ1 AND KDR | 0.977778 | 1 | 0.956522 | MLANA AND ABCC4 | 1 | 1 | 1 |
| NLGN1 AND NLGN1 | 0.917293 | 0.953125 | 0.884058 | MLANA AND IGSF6 | 1 | 1 | 1 |
| PRAF2 AND PRAF2 | 0.905109 | 0.911765 | 0.898551 | MLANA AND MLANA | 1 | 1 | 1 |
| SYT11 AND CD38 | 0.951049 | 0.918919 | 0.985507 | FDPS AND ZMPSTE24 | 1 | 1 | 1 |

FIG. 6 (cont.)

| Antigen Pair Logic | F1 | Precision | Recall | Antigen Pair Logic | F1 | Precision | Recall |
|---|---|---|---|---|---|---|---|
| SCRG1 AND CD38 | 0.909091 | 0.878378 | 0.942029 | MLANA AND MLANA | 1 | 1 | 1 |
| CHST10 AND CD38 | 0.915493 | 0.890411 | 0.942029 | MLANA AND SIGMAR1 | 1 | 1 | 1 |
| PRAF2 AND PRAF2 | 0.905109 | 0.911765 | 0.898551 | MLANA AND MLANA | 1 | 1 | 1 |
| TPST1 AND TPST1 | 0.917293 | 0.953125 | 0.884058 | MLANA AND LILRB2 | 1 | 1 | 1 |
| NLGN1 AND NLGN1 | 0.917293 | 0.953125 | 0.884058 | MLANA AND ADAM10 | 1 | 1 | 1 |
| PRAF2 AND PRAF2 | 0.905109 | 0.911765 | 0.898551 | MLANA AND MLANA | 1 | 1 | 1 |
| SYT11 AND MUC16 | 0.951049 | 0.918919 | 0.985507 | MLANA AND MLANA | 1 | 1 | 1 |
| SCRG1 AND MUC16 | 0.915493 | 0.890411 | 0.942029 | MLANA AND TMEM5 | 1 | 1 | 1 |
| AGPAT5 AND MUC16 | 0.905109 | 0.911765 | 0.898551 | FDPS AND TLR6 | 1 | 1 | 1 |
| CHST10 AND MUC16 | 0.915493 | 0.890411 | 0.942029 | MLANA AND MLANA | 1 | 1 | 1 |
| PRAF2 AND PRAF2 | 0.905109 | 0.911765 | 0.898551 | PARL AND ABCA9 | 1 | 1 | 1 |
| SYT11 AND IL3RA | 0.913043 | 0.913043 | 0.913043 | AUP1 AND ABCA8 | 1 | 1 | 1 |
| SCRG1 AND IL3RA | 0.901408 | 0.876712 | 0.927536 | PARL AND ABCA8 | 1 | 1 | 1 |
| TPST1 AND IL3RA | 0.909091 | 0.952381 | 0.869565 | MLANA AND BTN3A3 | 1 | 1 | 1 |
| CHST10 AND IL3RA | 0.907801 | 0.888889 | 0.927536 | MLANA AND BTN2A2 | 1 | 1 | 1 |
| PRAF2 AND PRAF2 | 0.905109 | 0.911765 | 0.898551 | MLANA AND CEPT1 | 1 | 1 | 1 |
| SYT11 AND MUC17 | 0.951049 | 0.918919 | 0.985507 | MLANA AND MLANA | 1 | 1 | 1 |
| CHST10 AND MUC17 | 0.915493 | 0.890411 | 0.942029 | FDPS AND NDRG1 | 1 | 1 | 1 |
| NLGN1 AND NLGN1 | 0.917293 | 0.953125 | 0.884058 | MLANA AND MLANA | 1 | 1 | 1 |
| ITGAV AND L1CAM | 0.920863 | 0.914286 | 0.927536 | FDPS AND PEMT | 1 | 1 | 1 |
| PRAF2 AND PRAF2 | 0.905109 | 0.911765 | 0.898551 | MLANA AND PEMT | 1 | 1 | 1 |
| SYT11 AND SYT11 | 0.951049 | 0.918919 | 0.985507 | MLANA AND MLANA | 1 | 1 | 1 |
| SCRG1 AND L1CAM | 0.909091 | 0.878378 | 0.942029 | AUP1 AND CDS1 | 1 | 1 | 1 |
| TPST1 AND L1CAM | 0.900763 | 0.951613 | 0.855072 | MLANA AND CDIPT | 1 | 1 | 1 |
| NLGN1 AND NLGN1 | 0.917293 | 0.953125 | 0.884058 | MLANA AND MLANA | 1 | 1 | 1 |
| ITGAV AND EPHA3 | 0.914286 | 0.901408 | 0.927536 | MLANA AND LYPLA1 | 1 | 1 | 1 |
| PRAF2 AND EPHA3 | 0.910448 | 0.938462 | 0.884058 | FDPS AND CD52 | 1 | 1 | 1 |
| SYT11 AND SYT11 | 0.951049 | 0.918919 | 0.985507 | MLANA AND MLANA | 1 | 1 | 1 |
| SCRG1 AND EPHA3 | 0.901408 | 0.876712 | 0.927536 | NPC1 AND CD52 | 1 | 1 | 1 |
| TPST1 AND EPHA3 | 0.917293 | 0.953125 | 0.884058 | MLANA AND TIMM17A | 1 | 1 | 1 |
| CHST10 AND EPHA3 | 0.907801 | 0.888889 | 0.927536 | FDPS AND GPNMB | 1 | 1 | 1 |
| PTPRZ1 AND EPHA3 | 0.978102 | 0.985294 | 0.971014 | MLANA AND MLANA | 1 | 1 | 1 |
| ITGAV AND MSLN | 0.93617 | 0.916667 | 0.956522 | NPC1 AND GPNMB | 1 | 1 | 1 |
| PRAF2 AND PRAF2 | 0.905109 | 0.911765 | 0.898551 | AUP1 AND GPNMB | 1 | 1 | 1 |
| SYT11 AND MSLN | 0.951049 | 0.918919 | 0.985507 | PARL AND GPNMB | 1 | 1 | 1 |
| SCRG1 AND MSLN | 0.909091 | 0.878378 | 0.942029 | MLANA AND MLANA | 1 | 1 | 1 |
| AGPAT5 AND MSLN | 0.905109 | 0.911765 | 0.898551 | FDPS AND SLC30A9 | 1 | 1 | 1 |
| CHST10 AND MSLN | 0.915493 | 0.890411 | 0.942029 | MLANA AND MLANA | 1 | 1 | 1 |
| NLGN1 AND NLGN1 | 0.917293 | 0.953125 | 0.884058 | FDPS AND SLC9A6 | 1 | 1 | 1 |
| SYT11 AND SLAMF7 | 0.951049 | 0.918919 | 0.985507 | MLANA AND SLC9A6 | 1 | 1 | 1 |
| SCRG1 AND SLAMF7 | 0.909091 | 0.878378 | 0.942029 | MLANA AND MLANA | 1 | 1 | 1 |
| CHST10 AND SLAMF7 | 0.915493 | 0.890411 | 0.942029 | MLANA AND CRTAP | 1 | 1 | 1 |
| PRAF2 AND PRAF2 | 0.905109 | 0.911765 | 0.898551 | FDPS AND SEMA4B | 1 | 1 | 1 |
| SYT11 AND TNFRSF10A | 0.93617 | 0.916667 | 0.956522 | MLANA AND SEMA4B | 1 | 1 | 1 |
| CHST10 AND TNFRSF10A | 0.9 | 0.887324 | 0.913043 | MLANA AND MLANA | 1 | 1 | 1 |
| NLGN1 AND NLGN1 | 0.917293 | 0.953125 | 0.884058 | MLANA AND HYOU1 | 1 | 1 | 1 |
| PRAF2 AND PRAF2 | 0.905109 | 0.911765 | 0.898551 | FDPS AND PROCR | 1 | 1 | 1 |
| SYT11 AND MUC1 | 0.93617 | 0.916667 | 0.956522 | MLANA AND MLANA | 1 | 1 | 1 |
| AGPAT5 AND MUC1 | 0.905109 | 0.911765 | 0.898551 | AUP1 AND PROCR | 1 | 1 | 1 |
| CHST10 AND MUC1 | 0.9 | 0.887324 | 0.913043 | PARL AND PROCR | 1 | 1 | 1 |
| PTPRZ1 AND KCNE3 | 0.985507 | 0.985507 | 0.985507 | MLANA AND PRDX4 | 1 | 1 | 1 |
| CDH2 AND ITGAV | 0.970149 | 1 | 0.942029 | MLANA AND ARL6IP5 | 1 | 1 | 1 |
| CDH2 AND NDUFA4 | 0.977778 | 1 | 0.956522 | MLANA AND MLANA | 1 | 1 | 1 |
| GPM6B AND OST4 | 0.977778 | 1 | 0.956522 | MLANA AND AGPAT1 | 1 | 1 | 1 |

FIG. 6 (cont.)

| Antigen Pair Logic | F1 | Precision | Recall |
|---|---|---|---|
| PTPRZ1 AND OST4 | 0.977778 | 1 | 0.956522 |
| PTPRZ1 AND TMEM221 | 0.985507 | 0.985507 | 0.985507 |
| PTPRZ1 AND LRRC70 | 0.985507 | 0.985507 | 0.985507 |
| PTPRZ1 AND ARMCX4 | 0.985507 | 0.985507 | 0.985507 |
| PTPRZ1 AND CDH4 | 0.985507 | 0.985507 | 0.985507 |
| PTPRZ1 AND CDH5 | 0.992701 | 1 | 0.985507 |
| PTPRZ1 AND CDH6 | 0.985507 | 0.985507 | 0.985507 |
| PTPRZ1 AND 100505984? | 0.985507 | 0.985507 | 0.985507 |
| PTPRZ1 AND TMEM178B | 0.985507 | 0.985507 | 0.985507 |
| PTPRZ1 AND GJC1 | 0.985507 | 0.985507 | 0.985507 |
| PTPRZ1 AND ABCC9 | 0.985507 | 0.985507 | 0.985507 |
| PTPRZ1 AND SCAMP3 | 0.992701 | 1 | 0.985507 |
| PTPRZ1 AND MUC12 | 0.985507 | 0.985507 | 0.985507 |
| PTPRZ1 AND CDH10 | 0.985507 | 0.985507 | 0.985507 |
| PTPRZ1 AND TSPAN5 | 0.985507 | 0.985507 | 0.985507 |
| PTPRZ1 AND PREB | 0.992701 | 1 | 0.985507 |
| PTPRZ1 AND BCAP31 | 0.992701 | 1 | 0.985507 |
| PTPRZ1 AND LPAR6 | 0.977778 | 1 | 0.956522 |
| GPM6B AND CNIH1 | 0.977778 | 1 | 0.956522 |
| PTPRZ1 AND LHFPL2 | 0.985507 | 0.985507 | 0.985507 |
| PTPRZ1 AND LHFP | 0.985507 | 0.985507 | 0.985507 |
| PTPRZ1 AND ADAM8 | 0.985507 | 0.985507 | 0.985507 |
| PTPRZ1 AND MFSD10 | 0.985507 | 0.985507 | 0.985507 |
| PTPRZ1 AND STX6 | 0.985507 | 0.985507 | 0.985507 |
| PTPRZ1 AND COQ7 | 0.985507 | 0.985507 | 0.985507 |
| GPM6B AND SLC35B1 | 0.970149 | 1 | 0.942029 |
| PTPRZ1 AND SLC35B1 | 0.992701 | 1 | 0.985507 |
| PTPRZ1 AND KCNMB2 | 0.985507 | 0.985507 | 0.985507 |
| PTPRZ1 AND TIMM17B | 0.985507 | 0.985507 | 0.985507 |
| PTPRZ1 AND RAMP2 | 0.985507 | 0.985507 | 0.985507 |
| GPM6B AND ZMPSTE24 | 0.970149 | 1 | 0.942029 |
| PTPRZ1 AND ZMPSTE24 | 0.992701 | 1 | 0.985507 |
| PTPRZ1 AND BET1 | 0.985507 | 0.985507 | 0.985507 |
| PTPRZ1 AND LILRB2 | 0.985507 | 0.985507 | 0.985507 |
| PTPRZ1 AND TCIRG1 | 0.985507 | 0.985507 | 0.985507 |
| PTPRZ1 AND TMEM5 | 0.985507 | 0.985507 | 0.985507 |
| PTPRZ1 AND MRVI1 | 0.985507 | 0.985507 | 0.985507 |
| PTPRZ1 AND TRDN | 0.985507 | 0.985507 | 0.985507 |
| PTPRZ1 AND BTN2A2 | 0.985507 | 0.985507 | 0.985507 |
| PTPRZ1 AND PEMT | 0.992701 | 1 | 0.985507 |
| PTPRZ1 AND ST3GAL6 | 0.985507 | 0.985507 | 0.985507 |
| PTPRZ1 AND CDIPT | 0.977778 | 1 | 0.956522 |
| GPM6B AND PGRMC2 | 0.970149 | 1 | 0.942029 |
| PTPRZ1 AND TMEM147 | 0.992701 | 1 | 0.985507 |
| GPM6B AND LYPLA1 | 0.970149 | 1 | 0.942029 |
| PTPRZ1 AND TIMM17A | 0.992701 | 1 | 0.985507 |
| PTPRZ1 AND LRRN2 | 0.985507 | 0.985507 | 0.985507 |
| PTPRZ1 AND GPNMB | 0.985507 | 0.985507 | 0.985507 |
| PTPRZ1 AND MERTK | 0.985507 | 0.985507 | 0.985507 |
| PTPRZ1 AND SLC30A9 | 0.985507 | 0.985507 | 0.985507 |
| PTPRZ1 AND CLGN | 0.985507 | 0.985507 | 0.985507 |
| PTPRZ1 AND VTI1B | 0.970149 | 1 | 0.942029 |
| PTPRZ1 AND CRTAP | 0.992701 | 1 | 0.985507 |
| PTPRZ1 AND SEMA4B | 0.985507 | 0.985507 | 0.985507 |

| Antigen Pair Logic | F1 | Precision | Recall |
|---|---|---|---|
| MLANA AND MLANA | 1 | 1 | 1 |
| MLANA AND SLC19A2 | 1 | 1 | 1 |
| FDPS AND RABAC1 | 1 | 1 | 1 |
| MLANA AND MLANA | 1 | 1 | 1 |
| MLANA AND IFITM2 | 1 | 1 | 1 |
| MLANA AND MLANA | 1 | 1 | 1 |
| MLANA AND ST6GALNAC2 | 1 | 1 | 1 |
| NPC1 AND ST6GALNAC2 | 1 | 1 | 1 |
| AUP1 AND ST6GALNAC2 | 1 | 1 | 1 |
| PARL AND ST6GALNAC2 | 1 | 1 | 1 |
| MLANA AND ERLIN1 | 1 | 1 | 1 |
| FDPS AND TGOLN2 | 1 | 1 | 1 |
| MLANA AND MLANA | 1 | 1 | 1 |
| MLANA AND MLANA | 1 | 1 | 1 |
| FDPS AND DMRT2 | 1 | 1 | 1 |
| MLANA AND MLANA | 1 | 1 | 1 |
| FDPS AND CXCR6 | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| NPC1 AND CSPG5 | 1 | 1 | 1 |
| AUP1 AND CSPG5 | 1 | 1 | 1 |
| MLANA AND MLANA | 1 | 1 | 1 |
| MLANA AND EBP | 1 | 1 | 1 |
| MLANA AND MLANA | 1 | 1 | 1 |
| MLANA AND NRG3 | 1 | 1 | 1 |
| MLANA AND MLANA | 1 | 1 | 1 |
| MLANA AND MLANA | 1 | 1 | 1 |
| MLANA AND PHTF1 | 1 | 1 | 1 |
| MLANA AND CHL1 | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| MLANA AND ADCY1 | 1 | 1 | 1 |
| MLANA AND MLANA | 1 | 1 | 1 |
| MLANA AND FAXDC2 | 1 | 1 | 1 |
| MLANA AND MLANA | 1 | 1 | 1 |
| MLANA AND USP19 | 1 | 1 | 1 |
| MLANA AND MLANA | 1 | 1 | 1 |
| MLANA AND MLANA | 1 | 1 | 1 |
| FDPS AND MMP24 | 1 | 1 | 1 |
| MLANA AND MLANA | 1 | 1 | 1 |
| MLANA AND YIF1A | 1 | 1 | 1 |
| MLANA AND MLANA | 1 | 1 | 1 |
| AUP1 AND ADCY2 | 1 | 1 | 1 |
| PARL AND ADCY2 | 1 | 1 | 1 |
| MLANA AND MLANA | 1 | 1 | 1 |
| FDPS AND MAN1A2 | 1 | 1 | 1 |
| MLANA AND MLANA | 1 | 1 | 1 |
| MLANA AND PNPLA6 | 1 | 1 | 1 |
| MLANA AND AFG3L2 | 1 | 1 | 1 |

FIG. 6 (cont.)

| Antigen Pair Logic | F1 | Precision | Recall | Antigen Pair Logic | F1 | Precision | Recall |
|---|---|---|---|---|---|---|---|
| PTPRZ1 AND DEAF1 | 0.985507 | 0.985507 | 0.985507 | MLANA AND MLANA | 1 | 1 | 1 |
| GPM6B AND TM9SF1 | 0.970149 | 1 | 0.942029 | MLANA AND MLANA | 1 | 1 | 1 |
| PTPRZ1 AND TM9SF1 | 0.970149 | 1 | 0.942029 | MLANA AND OS9 | 1 | 1 | 1 |
| GPM6B AND PRDX4 | 0.985294 | 1 | 0.971014 | MLANA AND MLANA | 1 | 1 | 1 |
| PTPRZ1 AND PRDX4 | 0.985294 | 1 | 0.971014 | MLANA AND LMAN2 | 1 | 1 | 1 |
| PTPRZ1 AND ARL6IP5 | 0.970149 | 1 | 0.942029 | MLANA AND MLANA | 1 | 1 | 1 |
| PTPRZ1 AND AGPAT1 | 0.992701 | 1 | 0.985507 | MLANA AND MLANA | 1 | 1 | 1 |
| PTPRZ1 AND SLC35A1 | 0.977778 | 1 | 0.956522 | MLANA AND MLANA | 1 | 1 | 1 |
| PTPRZ1 AND SLC19A2 | 0.992701 | 1 | 0.985507 | MLANA AND MLANA | 1 | 1 | 1 |
| PTPRZ1 AND RABAC1 | 0.985507 | 0.985507 | 0.985507 | MLANA AND MLANA | 1 | 1 | 1 |
| PTPRZ1 AND SLC34A2 | 0.985507 | 0.985507 | 0.985507 | FDPS AND ILVBL | 1 | 1 | 1 |
| PTPRZ1 AND IFITM2 | 0.977778 | 1 | 0.956522 | MLANA AND ILVBL | 1 | 1 | 1 |
| PTPRZ1 AND TGOLN2 | 0.985507 | 0.985507 | 0.985507 | MLANA AND SLC27A5 | 1 | 1 | 1 |
| PTPRZ1 AND PDPN | 0.985507 | 0.985507 | 0.985507 | MLANA AND MLANA | 1 | 1 | 1 |
| PTPRZ1 AND CD226 | 0.985507 | 0.985507 | 0.985507 | MLANA AND MLANA | 1 | 1 | 1 |
| PTPRZ1 AND CGRRF1 | 0.985507 | 0.985507 | 0.985507 | FDPS AND SLC27A3 | 1 | 1 | 1 |
| PTPRZ1 AND TNFSF13B | 0.985507 | 0.985507 | 0.985507 | MLANA AND MLANA | 1 | 1 | 1 |
| PTPRZ1 AND DLL3 | 0.985507 | 0.985507 | 0.985507 | MLANA AND MLANA | 1 | 1 | 1 |
| PTPRZ1 AND CERS1 | 0.985507 | 0.985507 | 0.985507 | MLANA AND LILRB4 | 1 | 1 | 1 |
| CERS1 AND PTTG1IP | 0.970149 | 1 | 0.942029 | MLANA AND MLANA | 1 | 1 | 1 |
| PTPRZ1 AND YME1L1 | 0.970149 | 1 | 0.942029 | MLANA AND KDELR2 | 1 | 1 | 1 |
| PTPRZ1 AND PHTF1 | 0.985507 | 0.985507 | 0.985507 | MLANA AND KDELR3 | 1 | 1 | 1 |
| PTPRZ1 AND CHL1 | 0.985507 | 0.985507 | 0.985507 | MLANA AND MLANA | 1 | 1 | 1 |
| PTPRZ1 AND VAMP5 | 0.985507 | 0.985507 | 0.985507 | MLANA AND TMED1 | 1 | 1 | 1 |
| PTPRZ1 AND ADAM28 | 0.985507 | 0.985507 | 0.985507 | MLANA AND TDRKH | 1 | 1 | 1 |
| PTPRZ1 AND TSPAN9 | 0.985294 | 1 | 0.971014 | MLANA AND LILRB3 | 1 | 1 | 1 |
| PTPRZ1 AND HCST | 0.985507 | 0.985507 | 0.985507 | MLANA AND B4GAT1 | 1 | 1 | 1 |
| PTPRZ1 AND LYVE1 | 0.985507 | 0.985507 | 0.985507 | AUP1 AND B4GAT1 | 1 | 1 | 1 |
| PTPRZ1 AND JTB | 0.970149 | 1 | 0.942029 | MLANA AND SLC35D2 | 1 | 1 | 1 |
| PTPRZ1 AND CEACAM4 | 0.985507 | 0.985507 | 0.985507 | MLANA AND CYB561D2 | 1 | 1 | 1 |
| PTPRZ1 AND MAN1A2 | 0.977778 | 1 | 0.956522 | MLANA AND TMEM115 | 1 | 1 | 1 |
| PTPRZ1 AND PNPLA6 | 0.985507 | 0.985507 | 0.985507 | FDPS AND RER1 | 1 | 1 | 1 |
| PTPRZ1 AND GPR75 | 0.985507 | 0.985507 | 0.985507 | MLANA AND MLANA | 1 | 1 | 1 |
| PTPRZ1 AND KDELR1 | 0.985294 | 1 | 0.971014 | MLANA AND MLANA | 1 | 1 | 1 |
| PTPRZ1 AND STARD3 | 0.985507 | 0.985507 | 0.985507 | MLANA AND MLANA | 1 | 1 | 1 |
| PTPRZ1 AND OS9 | 0.992701 | 1 | 0.985507 | MLANA AND MLANA | 1 | 1 | 1 |
| PTPRZ1 AND TMED2 | 0.985507 | 0.985507 | 0.985507 | MLANA AND BTN2A1 | 1 | 1 | 1 |
| PTPRZ1 AND LMAN2 | 0.970149 | 1 | 0.942029 | MLANA AND MLANA | 1 | 1 | 1 |
| PTPRZ1 AND ERP29 | 0.977778 | 1 | 0.956522 | MLANA AND MLANA | 1 | 1 | 1 |
| PTPRZ1 AND UQCR11 | 0.985294 | 1 | 0.971014 | MLANA AND MLANA | 1 | 1 | 1 |
| PTPRZ1 AND SLC38A3 | 0.985507 | 0.985507 | 0.985507 | MLANA AND BVES | 1 | 1 | 1 |
| PTPRZ1 AND ILVBL | 0.985507 | 0.985507 | 0.985507 | MLANA AND MLANA | 1 | 1 | 1 |
| PTPRZ1 AND SLC27A3 | 0.985507 | 0.985507 | 0.985507 | MLANA AND C14orf1 | 1 | 1 | 1 |
| PTPRZ1 AND LILRB4 | 0.985507 | 0.985507 | 0.985507 | MLANA AND MLANA | 1 | 1 | 1 |
| PTPRZ1 AND GLIPR1 | 0.985507 | 0.985507 | 0.985507 | NPC1 AND CHI3L2 | 1 | 1 | 1 |
| PTPRZ1 AND KDELR2 | 0.977778 | 1 | 0.956522 | MLANA AND SLC2A6 | 1 | 1 | 1 |
| PTPRZ1 AND ATF7 | 0.985507 | 0.985507 | 0.985507 | MLANA AND MLANA | 1 | 1 | 1 |
| PTPRZ1 AND TMED1 | 0.970149 | 1 | 0.942029 | MLANA AND MLANA | 1 | 1 | 1 |
| PTPRZ1 AND TDRKH | 0.985507 | 0.985507 | 0.985507 | MLANA AND MLANA | 1 | 1 | 1 |
| PTPRZ1 AND CYB561D2 | 0.985507 | 0.985507 | 0.985507 | MLANA AND PRAF2 | 1 | 1 | 1 |
| PTPRZ1 AND CACFD1 | 0.985507 | 0.985507 | 0.985507 | MLANA AND MLANA | 1 | 1 | 1 |
| PTPRZ1 AND BTN2A1 | 0.985507 | 0.985507 | 0.985507 | MLANA AND MLANA | 1 | 1 | 1 |
| PTPRZ1 AND FICD | 0.985507 | 0.985507 | 0.985507 | MLANA AND MLANA | 1 | 1 | 1 |
| PTPRZ1 AND CHI3L2 | 0.985507 | 0.985507 | 0.985507 | MLANA AND MLANA | 1 | 1 | 1 |

FIG. 6 (cont.)

| Antigen Pair Logic | F1 | Precision | Recall | Antigen Pair Logic | F1 | Precision | Recall |
|---|---|---|---|---|---|---|---|
| PTPRZ1 AND GALNT5 | 0.985507 | 0.985507 | 0.985507 | FDPS AND PTGDR2 | 1 | 1 | 1 |
| PTPRZ1 AND PRAF2 | 0.992701 | 1 | 0.985507 | FDPS AND MAN1B1 | 1 | 1 | 1 |
| PTPRZ1 AND SEC63 | 0.992701 | 1 | 0.985507 | MLANA AND MLANA | 1 | 1 | 1 |
| GPM6B AND RNF139 | 0.977778 | 1 | 0.956522 | MLANA AND MLANA | 1 | 1 | 1 |
| PTPRZ1 AND RNF139 | 0.977778 | 1 | 0.956522 | MLANA AND CMTM7 | 1 | 1 | 1 |
| PTPRZ1 AND GPR176 | 0.985507 | 0.985507 | 0.985507 | MLANA AND KLHL2 | 1 | 1 | 1 |
| PTPRZ1 AND MAN1B1 | 0.985507 | 0.985507 | 0.985507 | MLANA AND GLMP | 1 | 1 | 1 |
| PTPRZ1 AND NRM | 0.970149 | 1 | 0.942029 | MLANA AND MLANA | 1 | 1 | 1 |
| PTPRZ1 AND GLMP | 0.985507 | 0.985507 | 0.985507 | MLANA AND MGAT4B | 1 | 1 | 1 |
| PTPRZ1 AND HOGA1 | 0.985507 | 0.985507 | 0.985507 | MLANA AND MLANA | 1 | 1 | 1 |
| PTPRZ1 AND MGAT4B | 0.985294 | 1 | 0.971014 | MLANA AND MLANA | 1 | 1 | 1 |
| PTPRZ1 AND B4GALT7 | 0.985507 | 0.985507 | 0.985507 | FDPS AND ADCY6 | 1 | 1 | 1 |
| PTPRZ1 AND ADCY6 | 0.985507 | 0.985507 | 0.985507 | MLANA AND MLANA | 1 | 1 | 1 |
| PTPRZ1 AND PTH2 | 0.985507 | 0.985507 | 0.985507 | AUP1 AND ADCY6 | 1 | 1 | 1 |
| PTPRZ1 AND SLCO2B1 | 0.985507 | 0.985507 | 0.985507 | PARL AND ADCY6 | 1 | 1 | 1 |
| PTPRZ1 AND CD300A | 0.985507 | 0.985507 | 0.985507 | MLANA AND MLANA | 1 | 1 | 1 |
| PTPRZ1 AND CASC4 | 0.985507 | 0.985507 | 0.985507 | MLANA AND MGAT4A | 1 | 1 | 1 |
| PTPRZ1 AND MGAT4A | 0.992701 | 1 | 0.985507 | MLANA AND MLANA | 1 | 1 | 1 |
| PTPRZ1 AND SLC46A1 | 0.985507 | 0.985507 | 0.985507 | MLANA AND SLC46A1 | 1 | 1 | 1 |
| PTPRZ1 AND GLCCI1 | 0.985507 | 0.985507 | 0.985507 | MLANA AND MLANA | 1 | 1 | 1 |
| PTPRZ1 AND TMEM106A | 0.985507 | 0.985507 | 0.985507 | MLANA AND TMEM106A | 1 | 1 | 1 |
| PTPRZ1 AND TEX261 | 0.970149 | 1 | 0.942029 | MLANA AND SFT2D1 | 1 | 1 | 1 |
| PTPRZ1 AND SCRG1 | 0.985294 | 1 | 0.971014 | MLANA AND TEX261 | 1 | 1 | 1 |
| PTPRZ1 AND RNF13 | 0.985507 | 0.985507 | 0.985507 | MLANA AND RNF13 | 1 | 1 | 1 |
| PTPRZ1 AND ADCY7 | 0.985507 | 0.985507 | 0.985507 | MLANA AND MLANA | 1 | 1 | 1 |
| PTPRZ1 AND LRRC37B | 0.985507 | 0.985507 | 0.985507 | MLANA AND MLANA | 1 | 1 | 1 |
| PTPRZ1 AND XKR4 | 0.985507 | 0.985507 | 0.985507 | MLANA AND CMTM1 | 1 | 1 | 1 |
| PTPRZ1 AND SLC25A25 | 0.985294 | 1 | 0.971014 | MLANA AND CYP2U1 | 1 | 1 | 1 |
| PTPRZ1 AND ELFN2 | 0.985507 | 0.985507 | 0.985507 | MLANA AND MLANA | 1 | 1 | 1 |
| PTPRZ1 AND TMEM132B | 0.985507 | 0.985507 | 0.985507 | MLANA AND SDSL | 1 | 1 | 1 |
| PTPRZ1 AND GALNT13 | 0.985507 | 0.985507 | 0.985507 | MLANA AND MLANA | 1 | 1 | 1 |
| PTPRZ1 AND C1QTNF1 | 0.985507 | 0.985507 | 0.985507 | FDPS AND CHRNB1 | 1 | 1 | 1 |
| PTPRZ1 AND C1QTNF6 | 0.985507 | 0.985507 | 0.985507 | MLANA AND MLANA | 1 | 1 | 1 |
| PTPRZ1 AND TMEM123 | 0.992701 | 1 | 0.985507 | MLANA AND SLC2A13 | 1 | 1 | 1 |
| GPM6B AND SMIM19 | 0.985294 | 1 | 0.971014 | FDPS AND CHRNB4 | 1 | 1 | 1 |
| PTPRZ1 AND SMIM19 | 0.985294 | 1 | 0.971014 | NPC1 AND MAL2 | 1 | 1 | 1 |
| PTPRZ1 AND ADCY8 | 0.985507 | 0.985507 | 0.985507 | AUP1 AND MAL2 | 1 | 1 | 1 |
| PTPRZ1 AND MARCH3 | 0.985507 | 0.985507 | 0.985507 | PARL AND MAL2 | 1 | 1 | 1 |
| PTPRZ1 AND OMA1 | 0.985507 | 0.985507 | 0.985507 | MLANA AND MLANA | 1 | 1 | 1 |
| PTPRZ1 AND EVI5L | 0.985507 | 0.985507 | 0.985507 | FDPS AND PKD1L2 | 1 | 1 | 1 |
| PTPRZ1 AND LRRC3B | 0.985507 | 0.985507 | 0.985507 | MLANA AND MLANA | 1 | 1 | 1 |
| PTPRZ1 AND FAM210B | 0.985507 | 0.985507 | 0.985507 | MLANA AND MLANA | 1 | 1 | 1 |
| PTPRZ1 AND CMTM5 | 0.985507 | 0.985507 | 0.985507 | MLANA AND MLANA | 1 | 1 | 1 |
| PTPRZ1 AND ABHD15 | 0.985507 | 0.985507 | 0.985507 | MLANA AND SORCS1 | 1 | 1 | 1 |
| PTPRZ1 AND LYPD1 | 0.985507 | 0.985507 | 0.985507 | MLANA AND MLANA | 1 | 1 | 1 |
| PTPRZ1 AND TM4SF18 | 0.985507 | 0.985507 | 0.985507 | MLANA AND MLANA | 1 | 1 | 1 |
| PTPRZ1 AND SLC18B1 | 0.985507 | 0.985507 | 0.985507 | MLANA AND MLANA | 1 | 1 | 1 |
| PTPRZ1 AND GALNT15 | 0.985507 | 0.985507 | 0.985507 | MLANA AND MLANA | 1 | 1 | 1 |
| PTPRZ1 AND CLCN2 | 0.985507 | 0.985507 | 0.985507 | MLANA AND MLANA | 1 | 1 | 1 |
| PTPRZ1 AND CLCN3 | 0.985507 | 0.985507 | 0.985507 | MLANA AND SLC25A26 | 1 | 1 | 1 |
| PTPRZ1 AND ANTXR2 | 0.985507 | 0.985507 | 0.985507 | MLANA AND MLANA | 1 | 1 | 1 |
| PTPRZ1 AND SFXN2 | 0.985507 | 0.985507 | 0.985507 | MLANA AND FCRL3 | 1 | 1 | 1 |
| PTPRZ1 AND CLN3 | 0.985507 | 0.985507 | 0.985507 | MLANA AND MLANA | 1 | 1 | 1 |
| PTPRZ1 AND CYP2R1 | 0.985507 | 0.985507 | 0.985507 | MLANA AND LYSMD3 | 1 | 1 | 1 |

FIG. 6 (cont.)

| Antigen Pair Logic | F1 | Precision | Recall |
|---|---|---|---|
| PTPRZ1 AND TMEM52B | 0.985507 | 0.985507 | 0.985507 |
| PTPRZ1 AND CLPTM1 | 0.985507 | 0.985507 | 0.985507 |
| PTPRZ1 AND SLC15A4 | 0.985507 | 0.985507 | 0.985507 |
| PTPRZ1 AND PLD4 | 0.985507 | 0.985507 | 0.985507 |
| PTPRZ1 AND CCR1 | 0.985507 | 0.985507 | 0.985507 |
| PTPRZ1 AND CCR5 | 0.985507 | 0.985507 | 0.985507 |
| PTPRZ1 AND CMTM3 | 0.977778 | 1 | 0.956522 |
| PTPRZ1 AND CMKLR1 | 0.985507 | 0.985507 | 0.985507 |
| PTPRZ1 AND TMEM219 | 0.992701 | 1 | 0.985507 |
| PTPRZ1 AND SLC38A10 | 0.985507 | 0.985507 | 0.985507 |
| PTPRZ1 AND CANT1 | 0.985507 | 0.985507 | 0.985507 |
| PTPRZ1 AND TMEM132E | 0.985507 | 0.985507 | 0.985507 |
| PTPRZ1 AND SEZ6 | 0.985507 | 0.985507 | 0.985507 |
| PTPRZ1 AND CYB5D2 | 0.985294 | 1 | 0.971014 |
| GPM6B AND FAM210A | 0.970149 | 1 | 0.942029 |
| PTPRZ1 AND FAM210A | 0.992701 | 1 | 0.985507 |
| PTPRZ1 AND FAM69C | 0.985507 | 0.985507 | 0.985507 |
| PTPRZ1 AND CLDND2 | 0.985507 | 0.985507 | 0.985507 |
| PTPRZ1 AND ACER1 | 0.992701 | 1 | 0.985507 |
| PTPRZ1 AND CPT1C | 0.985507 | 0.985507 | 0.985507 |
| PTPRZ1 AND CNGA3 | 0.985507 | 0.985507 | 0.985507 |
| PTPRZ1 AND TMIGD2 | 0.985507 | 0.985507 | 0.985507 |
| PTPRZ1 AND MFSD12 | 0.985507 | 0.985507 | 0.985507 |
| GPM6B AND NDUFA11 | 0.977778 | 1 | 0.956522 |
| PTPRZ1 AND NDUFA11 | 0.985294 | 1 | 0.971014 |
| PTPRZ1 AND LRRC25 | 0.985507 | 0.985507 | 0.985507 |
| GPM6B AND B3GALT6 | 0.985294 | 1 | 0.971014 |
| PTPRZ1 AND B3GALT6 | 0.977778 | 1 | 0.956522 |
| PTPRZ1 AND RNF19B | 0.985507 | 0.985507 | 0.985507 |
| PTPRZ1 AND TEDDM1 | 0.985507 | 0.985507 | 0.985507 |
| PTPRZ1 AND DRAM2 | 0.992701 | 1 | 0.985507 |
| PTPRZ1 AND C1orf162 | 0.985507 | 0.985507 | 0.985507 |
| PTPRZ1 AND NKAIN4 | 0.985507 | 0.985507 | 0.985507 |
| PTPRZ1 AND COL4A2 | 0.985507 | 0.985507 | 0.985507 |
| PTPRZ1 AND TBC1D20 | 0.985507 | 0.985507 | 0.985507 |
| PTPRZ1 AND CST9L | 0.985507 | 0.985507 | 0.985507 |
| PTPRZ1 AND EMID1 | 0.985507 | 0.985507 | 0.985507 |
| PTPRZ1 AND TMEM150A | 0.985507 | 0.985507 | 0.985507 |
| PTPRZ1 AND MBOAT2 | 0.977778 | 1 | 0.956522 |
| PTPRZ1 AND PQLC3 | 0.985294 | 1 | 0.971014 |
| PTPRZ1 AND TMEM182 | 0.985507 | 0.985507 | 0.985507 |
| PTPRZ1 AND DNAJC19 | 0.985507 | 0.985507 | 0.985507 |
| PTPRZ1 AND DCBLD2 | 0.985507 | 0.985507 | 0.985507 |
| PTPRZ1 AND TPRA1 | 0.985507 | 0.985507 | 0.985507 |
| PTPRZ1 AND SLC31A1 | 0.992701 | 1 | 0.985507 |
| PTPRZ1 AND COX4I1 | 0.985294 | 1 | 0.971014 |
| PTPRZ1 AND AASDH | 0.985507 | 0.985507 | 0.985507 |
| PTPRZ1 AND COX7A2 | 0.985294 | 1 | 0.971014 |
| PTPRZ1 AND B3GAT2 | 0.985507 | 0.985507 | 0.985507 |
| PTPRZ1 AND COX8A | 0.985294 | 1 | 0.971014 |
| PTPRZ1 AND COX15 | 0.985507 | 0.985507 | 0.985507 |
| PTPRZ1 AND CPD | 0.970149 | 1 | 0.942029 |
| PTPRZ1 AND CPT1A | 0.985507 | 0.985507 | 0.985507 |
| PTPRZ1 AND TMEM68 | 0.985507 | 0.985507 | 0.985507 |

| Antigen Pair Logic | F1 | Precision | Recall |
|---|---|---|---|
| MLANA AND FAM210B | 1 | 1 | 1 |
| FDPS AND ABHD15 | 1 | 1 | 1 |
| MLANA AND ABHD15 | 1 | 1 | 1 |
| NPC1 AND ABHD15 | 1 | 1 | 1 |
| MLANA AND MLANA | 1 | 1 | 1 |
| Astrocytoma (Astrocytoma) | | | |
| PTPRZ1 AND CLCN5 | 0.911111 | 0.931818 | 0.891304 |
| PTPRZ1 AND ADGRE1 | 0.917647 | 1 | 0.847826 |
| PTPRZ1 AND F2R | 0.930233 | 1 | 0.869565 |
| PTPRZ1 AND CYB561A3 | 0.901099 | 0.911111 | 0.891304 |
| PTPRZ1 AND IL27 | 0.901099 | 0.911111 | 0.891304 |
| PTPRZ1 AND HAS2 | 0.917647 | 1 | 0.847826 |
| PTPRZ1 AND LCAT | 0.91954 | 0.97561 | 0.869565 |
| PTPRZ1 AND ATP13A1 | 0.909091 | 0.952381 | 0.869565 |
| Neuroblastoma (Neuroblastoma) | | | |
| MARCH11 | 0.924855 | 0.898876 | 0.952381 |
| CHRNA3 | 0.927711 | 0.939024 | 0.916667 |
| ST8SIA2 | 0.922156 | 0.927711 | 0.916667 |
| MARCH11 AND SDC1 | 0.905882 | 0.895349 | 0.916667 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| ST8SIA2 AND CD70 | 0.922156 | 0.927711 | 0.916667 |
| CHRNA3 AND CHRNA3 | 0.91358 | 0.948718 | 0.880952 |
| MARCH11 AND CD44 | 0.912281 | 0.896552 | 0.928571 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| MARCH11 AND MARCH11 | 0.924855 | 0.898876 | 0.952381 |
| ST8SIA2 AND FOLR2 | 0.922156 | 0.927711 | 0.916667 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| ST8SIA2 AND SLAMF7 | 0.922156 | 0.927711 | 0.916667 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| DIABLO AND NCAM1 | 0.925 | 0.973684 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |

FIG. 6 (cont.)

| Antigen Pair Logic | F1 | Precision | Recall |
|---|---|---|---|
| PTPRZ1 AND CR1 | 0.985507 | 0.985507 | 0.985507 |
| PTPRZ1 AND AGPAT6 | 0.985507 | 0.985507 | 0.985507 |
| PTPRZ1 AND LETM2 | 0.985507 | 0.985507 | 0.985507 |
| PTPRZ1 AND FAM69B | 0.985507 | 0.985507 | 0.985507 |
| PTPRZ1 AND PTCHD1 | 0.985507 | 0.985507 | 0.985507 |
| PTPRZ1 AND TMEM37 | 0.985507 | 0.985507 | 0.985507 |
| GPM6B AND ROMO1 | 0.977778 | 1 | 0.956522 |
| PTPRZ1 AND ROMO1 | 0.977778 | 1 | 0.956522 |
| PTPRZ1 AND SIRPA | 0.985507 | 0.985507 | 0.985507 |
| PTPRZ1 AND ADORA3 | 0.985507 | 0.985507 | 0.985507 |
| PTPRZ1 AND SAMD8 | 0.985507 | 0.985507 | 0.985507 |
| PTPRZ1 AND CSF1 | 0.985507 | 0.985507 | 0.985507 |
| PTPRZ1 AND FAM76B | 0.985507 | 0.985507 | 0.985507 |
| PTPRZ1 AND CSF2RA | 0.985507 | 0.985507 | 0.985507 |
| PTPRZ1 AND LAYN | 0.985507 | 0.985507 | 0.985507 |
| PTPRZ1 AND OR10A5 | 0.985507 | 0.985507 | 0.985507 |
| PTPRZ1 AND CSF3R | 0.985507 | 0.985507 | 0.985507 |
| PTPRZ1 AND ALG10B | 0.985507 | 0.985507 | 0.985507 |
| PTPRZ1 AND B3GLCT | 0.985507 | 0.985507 | 0.985507 |
| PTPRZ1 AND PRIMA1 | 0.985507 | 0.985507 | 0.985507 |
| PTPRZ1 AND C14orf37 | 0.985507 | 0.985507 | 0.985507 |
| PTPRZ1 AND CMTM2 | 0.985507 | 0.985507 | 0.985507 |
| PTPRZ1 AND CSPG4 | 0.985507 | 0.985507 | 0.985507 |
| PTPRZ1 AND CD300LF | 0.985507 | 0.985507 | 0.985507 |
| PTPRZ1 AND SLC47A2 | 0.985507 | 0.985507 | 0.985507 |
| PTPRZ1 AND TMEM199 | 0.985507 | 0.985507 | 0.985507 |
| PTPRZ1 AND DHRS13 | 0.985507 | 0.985507 | 0.985507 |
| GPM6B AND DPY19L3 | 0.985294 | 1 | 0.971014 |
| PTPRZ1 AND DPY19L3 | 0.970149 | 1 | 0.942029 |
| PTPRZ1 AND SYT6 | 0.985507 | 0.985507 | 0.985507 |
| PTPRZ1 AND SLC30A7 | 0.985507 | 0.985507 | 0.985507 |
| PTPRZ1 AND CNIH3 | 0.985507 | 0.985507 | 0.985507 |
| PTPRZ1 AND MANEAL | 0.985507 | 0.985507 | 0.985507 |
| PTPRZ1 AND ITPRIPL1 | 0.985507 | 0.985507 | 0.985507 |
| PTPRZ1 AND PLB1 | 0.985507 | 0.985507 | 0.985507 |
| PTPRZ1 AND ARL6IP6 | 0.985507 | 0.985507 | 0.985507 |
| PTPRZ1 AND METTL21A | 0.977778 | 1 | 0.956522 |
| PTPRZ1 AND GPR155 | 0.985507 | 0.985507 | 0.985507 |
| PTPRZ1 AND XXYLT1 | 0.985507 | 0.985507 | 0.985507 |
| PTPRZ1 AND IGSF11 | 0.985507 | 0.985507 | 0.985507 |
| PTPRZ1 AND CX3CR1 | 0.985507 | 0.985507 | 0.985507 |
| PTPRZ1 AND MGAT4D | 0.985507 | 0.985507 | 0.985507 |
| PTPRZ1 AND THAP6 | 0.992701 | 1 | 0.985507 |
| GPM6B AND SLC38A9 | 0.992701 | 1 | 0.985507 |
| PTPRZ1 AND SLC38A9 | 0.992701 | 1 | 0.985507 |
| PTPRZ1 AND SPINK13 | 0.985507 | 0.985507 | 0.985507 |
| PTPRZ1 AND TMEM161B | 0.985507 | 0.985507 | 0.985507 |
| PTPRZ1 AND CYBA | 0.992701 | 1 | 0.985507 |
| PTPRZ1 AND ARSK | 0.985507 | 0.985507 | 0.985507 |
| PTPRZ1 AND CYBB | 0.985507 | 0.985507 | 0.985507 |
| PTPRZ1 AND CCDC112 | 0.985507 | 0.985507 | 0.985507 |
| GPM6B AND CCDC167 | 0.977778 | 1 | 0.956522 |
| PTPRZ1 AND CCDC167 | 0.970149 | 1 | 0.942029 |
| PTPRZ1 AND ABCA13 | 0.985507 | 0.985507 | 0.985507 |

| Antigen Pair Logic | F1 | Precision | Recall |
|---|---|---|---|
| ALK AND TMEM258 | 0.901961 | 1 | 0.821429 |
| CHRNA3 AND CHRNA3 | 0.91358 | 0.948718 | 0.880952 |
| DIABLO AND ALK | 0.9 | 0.947368 | 0.857143 |
| MARCH11 AND MARCH11 | 0.924855 | 0.898876 | 0.952381 |
| CHRNA3 AND CHRNA3 | 0.91358 | 0.948718 | 0.880952 |
| PCSK1N AND CD276 | 0.909091 | 0.925926 | 0.892857 |
| MARCH11 AND MARCH11 | 0.924855 | 0.898876 | 0.952381 |
| ST8SIA3 AND CD276 | 0.928571 | 0.928571 | 0.928571 |
| SYT11 AND CD276 | 0.904762 | 0.904762 | 0.904762 |
| SVOP AND CD276 | 0.9 | 0.947368 | 0.857143 |
| SCN3B AND CD276 | 0.914634 | 0.9375 | 0.892857 |
| NRSN1 AND CD276 | 0.9 | 0.947368 | 0.857143 |
| HMP19 AND CD276 | 0.906832 | 0.948052 | 0.869048 |
| GPR19 AND CD276 | 0.920245 | 0.949367 | 0.892857 |
| RTN1 AND CD276 | 0.944785 | 0.974684 | 0.916667 |
| FAIM2 AND CD276 | 0.901734 | 0.876404 | 0.928571 |
| LHFPL4 AND CD276 | 0.9 | 0.947368 | 0.857143 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND ERBB2 | 0.912281 | 0.896552 | 0.928571 |
| CHRNA3 AND CHRNA3 | 0.91358 | 0.948718 | 0.880952 |
| MARCH11 AND MARCH11 | 0.924855 | 0.898876 | 0.952381 |
| ST8SIA2 AND L1CAM | 0.922156 | 0.927711 | 0.916667 |
| CHRNA3 AND CHRNA3 | 0.91358 | 0.948718 | 0.880952 |
| DIABLO AND L1CAM | 0.925 | 0.973684 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND CHRNA3 | 0.91358 | 0.948718 | 0.880952 |
| MARCH11 AND MARCH11 | 0.924855 | 0.898876 | 0.952381 |
| CHRNA3 AND CHRNA3 | 0.91358 | 0.948718 | 0.880952 |
| CHRNA3 AND UBA2 | 0.956522 | 1 | 0.916667 |
| SLC10A4 AND UBA2 | 0.922222 | 0.864583 | 0.988095 |
| ST8SIA2 AND UBA2 | 0.956522 | 1 | 0.916667 |
| FAM163A AND CNIH1 | 0.932584 | 0.882979 | 0.988095 |
| FAM163A AND CLGN | 0.927374 | 0.873684 | 0.988095 |
| SCN3B AND NRM | 0.947368 | 0.931034 | 0.964286 |
| CHRNA3 AND COX7A2 | 0.950617 | 0.987179 | 0.916667 |
| MARCH11 AND CHRNA3 | 0.952381 | 0.952381 | 0.952381 |
| CHRNA3 AND PFN2 | 0.950617 | 0.987179 | 0.916667 |
| CHRNA3 AND SLC25A3 | 0.956522 | 1 | 0.916667 |
| CHRNA3 AND SLC38A2 | 0.936709 | 1 | 0.880952 |
| RTN1 AND CANT1 | 0.950617 | 0.987179 | 0.916667 |
| FAM163A AND MBOAT2 | 0.931818 | 0.891304 | 0.97619 |
| FAM163A AND COX4I1 | 0.943182 | 0.902174 | 0.988095 |
| ST8SIA2 AND COX4I1 | 0.936709 | 1 | 0.880952 |
| FAM163A AND AGPAT6 | 0.927374 | 0.873684 | 0.988095 |
| FAM163A AND ALG10B | 0.947368 | 0.931034 | 0.964286 |
| FAM163A AND CCDC112 | 0.942529 | 0.911111 | 0.97619 |
| FAM163A AND CCDC167 | 0.947368 | 0.931034 | 0.964286 |

FIG. 6 (cont.)

| Antigen Pair Logic | F1 | Precision | Recall |
|---|---|---|---|
| PTPRZ1 AND VKORC1L1 | 0.977778 | 1 | 0.956522 |
| PTPRZ1 AND ATP6V0E2 | 0.985507 | 0.985507 | 0.985507 |
| PTPRZ1 AND KCNU1 | 0.985507 | 0.985507 | 0.985507 |
| PTPRZ1 AND ARHGAP36 | 0.985507 | 0.985507 | 0.985507 |
| PTPRZ1 AND CYP19A1 | 0.985507 | 0.985507 | 0.985507 |
| PTPRZ1 AND DAD1 | 0.970149 | 1 | 0.942029 |
| GPM6B AND TMTC3 | 0.970149 | 1 | 0.942029 |
| PTPRZ1 AND TMEM229B | 0.985507 | 0.985507 | 0.985507 |
| PTPRZ1 AND MDGA2 | 0.985507 | 0.985507 | 0.985507 |
| PTPRZ1 AND RHBDL3 | 0.985507 | 0.985507 | 0.985507 |
| PTPRZ1 AND DCC | 0.985507 | 0.985507 | 0.985507 |
| PTPRZ1 AND LPPR5 | 0.985507 | 0.985507 | 0.985507 |
| PTPRZ1 AND DENND1B | 0.985507 | 0.985507 | 0.985507 |
| PTPRZ1 AND TOR1AIP2 | 0.985507 | 0.985507 | 0.985507 |
| PTPRZ1 AND ACE | 0.985507 | 0.985507 | 0.985507 |
| PTPRZ1 AND CABP7 | 0.985507 | 0.985507 | 0.985507 |
| PTPRZ1 AND DDOST | 0.977778 | 1 | 0.956522 |
| PTPRZ1 AND TMEM64 | 0.992701 | 1 | 0.985507 |
| PTPRZ1 AND TMEM252 | 0.985507 | 0.985507 | 0.985507 |
| PTPRZ1 AND SSBP4 | 0.992701 | 1 | 0.985507 |
| PTPRZ1 AND FAM9C | 0.985507 | 0.985507 | 0.985507 |
| GPM6B AND SPTSSA | 0.985294 | 1 | 0.971014 |
| PTPRZ1 AND SPTSSA | 0.985294 | 1 | 0.971014 |
| PTPRZ1 AND ABHD3 | 0.985507 | 0.985507 | 0.985507 |
| PTPRZ1 AND DHODH | 0.985507 | 0.985507 | 0.985507 |
| PTPRZ1 AND DPAGT1 | 0.985507 | 0.985507 | 0.985507 |
| PTPRZ1 AND DSCAM | 0.985507 | 0.985507 | 0.985507 |
| PTPRZ1 AND JAG1 | 0.985294 | 1 | 0.971014 |
| PTPRZ1 AND SLC26A2 | 0.977778 | 1 | 0.956522 |
| PTPRZ1 AND DTNA | 0.985507 | 0.985507 | 0.985507 |
| PTPRZ1 AND HBEGF | 0.985507 | 0.985507 | 0.985507 |
| GPM6B AND E2F5 | 0.985507 | 0.985507 | 0.985507 |
| PTPRZ1 AND E2F5 | 0.992701 | 1 | 0.985507 |
| PTPRZ1 AND APLNR | 0.985507 | 0.985507 | 0.985507 |
| PTPRZ1 AND GPR183 | 0.985507 | 0.985507 | 0.985507 |
| PTPRZ1 AND ECE1 | 0.985507 | 0.985507 | 0.985507 |
| PTPRZ1 AND S1PR1 | 0.985507 | 0.985507 | 0.985507 |
| PTPRZ1 AND S1PR3 | 0.985507 | 0.985507 | 0.985507 |
| PTPRZ1 AND EDNRA | 0.985294 | 1 | 0.971014 |
| PTPRZ1 AND EDNRB | 0.985507 | 0.985507 | 0.985507 |
| PTPRZ1 AND HIGD2A | 0.985294 | 1 | 0.971014 |
| PTPRZ1 AND EFNB3 | 0.985507 | 0.985507 | 0.985507 |
| PTPRZ1 AND EGF | 0.985507 | 0.985507 | 0.985507 |
| PTPRZ1 AND CELSR3 | 0.985507 | 0.985507 | 0.985507 |
| PTPRZ1 AND EGFR | 0.985507 | 0.985507 | 0.985507 |
| PTPRZ1 AND METTL7B | 0.985507 | 0.985507 | 0.985507 |
| PTPRZ1 AND MYRFL | 0.985507 | 0.985507 | 0.985507 |
| PTPRZ1 AND ABCA1 | 0.985294 | 1 | 0.971014 |
| SYT11 AND KRTCAP2 | 0.970149 | 1 | 0.942029 |
| GPM6A AND KRTCAP2 | 0.970149 | 1 | 0.942029 |
| PTPRZ1 AND ELN | 0.992701 | 1 | 0.985507 |
| PTPRZ1 AND RDM1 | 0.985507 | 0.985507 | 0.985507 |
| PTPRZ1 AND EMP1 | 0.985294 | 1 | 0.971014 |
| PTPRZ1 AND EMP3 | 0.985507 | 0.985507 | 0.985507 |

| Antigen Pair Logic | F1 | Precision | Recall |
|---|---|---|---|
| FAM163A AND SPTSSA | 0.931818 | 0.891304 | 0.97619 |
| FAM163A AND ABCB10 | 0.937143 | 0.901099 | 0.97619 |
| FAM163A AND SEC11A | 0.952381 | 0.952381 | 0.952381 |
| FAM163A AND SEC61G | 0.947977 | 0.921348 | 0.97619 |
| FAM163A AND MMD | 0.97076 | 0.954023 | 0.988095 |
| FAM163A AND LCLAT1 | 0.932584 | 0.882979 | 0.988095 |
| FAM163A AND LETMD1 | 0.932584 | 0.882979 | 0.988095 |
| FAM163A AND TMEM14A | 0.937143 | 0.901099 | 0.97619 |
| FAM163A AND CNIH4 | 0.927374 | 0.873684 | 0.988095 |
| FAM163A AND ALG5 | 0.927374 | 0.873684 | 0.988095 |
| FAM163A AND GUSB | 0.947977 | 0.921348 | 0.97619 |
| FAM163A AND PPAPDC2 | 0.942529 | 0.911111 | 0.97619 |
| FAM163A AND MARCH11 | 0.931818 | 0.891304 | 0.97619 |
| FAM163A AND IER3IP1 | 0.948571 | 0.912088 | 0.988095 |
| FAM163A AND FAM8A1 | 0.964706 | 0.953488 | 0.97619 |
| FAM163A AND TMEM14C | 0.942529 | 0.911111 | 0.97619 |
| FAM163A AND ATP5F1 | 0.954023 | 0.922222 | 0.988095 |
| FAM163A AND PFN2 | 0.959538 | 0.932584 | 0.988095 |
| FAM163A AND SLC25A3 | 0.965116 | 0.943182 | 0.988095 |
| FAM163A AND SLC38A2 | 0.969697 | 0.987654 | 0.952381 |
| FAM163A AND NDUFB11 | 0.954023 | 0.922222 | 0.988095 |
| FAM163A AND CRLS1 | 0.922222 | 0.864583 | 0.988095 |
| FAM163A AND ZDHHC4 | 0.932584 | 0.882979 | 0.988095 |
| FAM163A AND LRRC59 | 0.932584 | 0.882979 | 0.988095 |
| FAM163A AND PLGRKT | 0.948571 | 0.912088 | 0.988095 |
| FAM163A AND DIABLO | 0.957576 | 0.975309 | 0.940476 |
| FAM163A AND C5orf15 | 0.937143 | 0.901099 | 0.97619 |
| FAM163A AND VANGL2 | 0.942529 | 0.911111 | 0.97619 |
| FAM163A AND TXNDC16 | 0.952941 | 0.94186 | 0.964286 |
| FAM163A AND SELK | 0.936416 | 0.910112 | 0.964286 |
| FAM163A AND RTN1 | 0.937143 | 0.901099 | 0.97619 |
| FAM163A AND SMIM15 | 0.922222 | 0.864583 | 0.988095 |
| FAM163A AND MFSD1 | 0.94186 | 0.920455 | 0.964286 |
| FAM163A AND SLC20A1 | 0.932584 | 0.882979 | 0.988095 |
| FAM163A AND SSR2 | 0.922222 | 0.864583 | 0.988095 |
| FAM163A AND TMEM258 | 0.943182 | 0.902174 | 0.988095 |
| FAM163A AND GDAP1L1 | 0.927374 | 0.873684 | 0.988095 |
| FAM163A AND DERL1 | 0.922222 | 0.864583 | 0.988095 |
| FAM163A AND TUSC3 | 0.932584 | 0.882979 | 0.988095 |
| FAM163A AND NIPA2 | 0.947977 | 0.921348 | 0.97619 |
| FAM163A AND EMC6 | 0.932584 | 0.882979 | 0.988095 |
| FAM163A AND JAGN1 | 0.937853 | 0.892473 | 0.988095 |
| SLC10A4 AND CCDC112 | 0.953488 | 0.931818 | 0.97619 |
| SLC10A4 AND CCDC167 | 0.947368 | 0.931034 | 0.964286 |
| SLC10A4 AND SEC11A | 0.946746 | 0.941176 | 0.952381 |
| SLC10A4 AND SEC61G | 0.947977 | 0.921348 | 0.97619 |
| SLC10A4 AND MMD | 0.954023 | 0.922222 | 0.988095 |
| SLC10A4 AND MARCH11 | 0.953488 | 0.931818 | 0.97619 |
| SLC10A4 AND NNAT | 0.947368 | 0.931034 | 0.964286 |
| SLC10A4 AND IER3IP1 | 0.937853 | 0.892473 | 0.988095 |
| SLC10A4 AND FAM8A1 | 0.942529 | 0.911111 | 0.97619 |
| SLC10A4 AND CUTA | 0.931818 | 0.891304 | 0.97619 |
| SLC10A4 AND ATP5F1 | 0.932584 | 0.882979 | 0.988095 |
| SLC10A4 AND PFN2 | 0.937853 | 0.892473 | 0.988095 |

FIG. 6 (cont.)

| Antigen Pair Logic | F1 | Precision | Recall |
|---|---|---|---|
| PTPRZ1 AND TAPT1 | 0.985507 | 0.985507 | 0.985507 |
| PTPRZ1 AND DNAJC18 | 0.985507 | 0.985507 | 0.985507 |
| PTPRZ1 AND ENG | 0.985507 | 0.985507 | 0.985507 |
| PTPRZ1 AND ENPEP | 0.985507 | 0.985507 | 0.985507 |
| PTPRZ1 AND HTRA4 | 0.985507 | 0.985507 | 0.985507 |
| PTPRZ1 AND SUSD3 | 0.985507 | 0.985507 | 0.985507 |
| PTPRZ1 AND SLC25A43 | 0.985507 | 0.985507 | 0.985507 |
| PTPRZ1 AND STOM | 0.985507 | 0.985507 | 0.985507 |
| PTPRZ1 AND EPHB1 | 0.985507 | 0.985507 | 0.985507 |
| PTPRZ1 AND EPHB2 | 0.985507 | 0.985507 | 0.985507 |
| PTPRZ1 AND SLC44A5 | 0.985507 | 0.985507 | 0.985507 |
| PTPRZ1 AND STX2 | 0.985507 | 0.985507 | 0.985507 |
| PTPRZ1 AND CLN8 | 0.985507 | 0.985507 | 0.985507 |
| PTPRZ1 AND EPOR | 0.985507 | 0.985507 | 0.985507 |
| PTPRZ1 AND ERF | 0.985507 | 0.985507 | 0.985507 |
| PTPRZ1 AND ERN1 | 0.977778 | 1 | 0.956522 |
| PTPRZ1 AND EVI2B | 0.985507 | 0.985507 | 0.985507 |
| PTPRZ1 AND EXT1 | 0.970149 | 1 | 0.942029 |
| PTPRZ1 AND EXTL2 | 0.992701 | 1 | 0.985507 |
| GPM6B AND F2R | 0.992701 | 1 | 0.985507 |
| PTPRZ1 AND F2R | 0.985294 | 1 | 0.971014 |
| PTPRZ1 AND ALCAM | 0.985507 | 0.985507 | 0.985507 |
| PTPRZ1 AND F3 | 0.985507 | 0.985507 | 0.985507 |
| PTPRZ1 AND ACSL3 | 0.985507 | 0.985507 | 0.985507 |
| PTPRZ1 AND LRRC55 | 0.985507 | 0.985507 | 0.985507 |
| PTPRZ1 AND TMEM218 | 0.985507 | 0.985507 | 0.985507 |
| PTPRZ1 AND MPEG1 | 0.985507 | 0.985507 | 0.985507 |
| PTPRZ1 AND ABCA3 | 0.970149 | 1 | 0.942029 |
| PTPRZ1 AND FBN2 | 0.985507 | 0.985507 | 0.985507 |
| PTPRZ1 AND HEPACAM | 0.985507 | 0.985507 | 0.985507 |
| PTPRZ1 AND REEP3 | 0.985507 | 0.985507 | 0.985507 |
| PTPRZ1 AND FAM162B | 0.985507 | 0.985507 | 0.985507 |
| PTPRZ1 AND ADGRF5 | 0.985507 | 0.985507 | 0.985507 |
| PTPRZ1 AND C6orf89 | 0.992701 | 1 | 0.985507 |
| PTPRZ1 AND LEMD2 | 0.985507 | 0.985507 | 0.985507 |
| PTPRZ1 AND FCGR3B | 0.985507 | 0.985507 | 0.985507 |
| PTPRZ1 AND RNF182 | 0.985507 | 0.985507 | 0.985507 |
| PTPRZ1 AND FCGRT | 0.985507 | 0.985507 | 0.985507 |
| PTPRZ1 AND DAGLB | 0.985507 | 0.985507 | 0.985507 |
| PTPRZ1 AND THSD7A | 0.985507 | 0.985507 | 0.985507 |
| GPM6B AND TMED4 | 0.977778 | 1 | 0.956522 |
| PTPRZ1 AND TMED4 | 0.977778 | 1 | 0.956522 |
| PTPRZ1 AND FCN2 | 0.985507 | 0.985507 | 0.985507 |
| PTPRZ1 AND LHFPL5 | 0.985507 | 0.985507 | 0.985507 |
| GPM6B AND ALDH3A2 | 0.977778 | 1 | 0.956522 |
| PTPRZ1 AND ALDH3A2 | 0.977778 | 1 | 0.956522 |
| PTPRZ1 AND FGFR1 | 0.985507 | 0.985507 | 0.985507 |
| PTPRZ1 AND FKBP1A | 0.985507 | 0.985507 | 0.985507 |
| PTPRZ1 AND NLGN4Y | 0.985507 | 0.985507 | 0.985507 |
| PTPRZ1 AND ADGRL1 | 0.985507 | 0.985507 | 0.985507 |
| PTPRZ1 AND SLITRK3 | 0.985507 | 0.985507 | 0.985507 |
| PTPRZ1 AND NLGN1 | 0.970149 | 1 | 0.942029 |
| PTPRZ1 AND SACM1L | 0.985507 | 0.985507 | 0.985507 |
| PTPRZ1 AND DIP2C | 0.985507 | 0.985507 | 0.985507 |

| Antigen Pair Logic | F1 | Precision | Recall |
|---|---|---|---|
| SLC10A4 AND PCDHB10 | 0.946746 | 0.941176 | 0.952381 |
| SLC10A4 AND DIABLO | 0.951807 | 0.963415 | 0.940476 |
| SLC10A4 AND RTN2 | 0.922222 | 0.864583 | 0.988095 |
| SLC10A4 AND TMEM258 | 0.954023 | 0.922222 | 0.988095 |
| SLC10A4 AND GDAP1L1 | 0.922222 | 0.864583 | 0.988095 |
| MARCH11 AND CTDNEP1 | 0.946746 | 0.941176 | 0.952381 |
| MARCH11 AND MMD | 0.943396 | 1 | 0.892857 |
| PCSK1N AND TMEM258 | 0.957576 | 0.975309 | 0.940476 |
| GPR19 AND TMEM258 | 0.95122 | 0.975 | 0.928571 |
| TMEM145 AND SLC38A2 | 0.95122 | 0.975 | 0.928571 |
| TMEM145 AND TMEM258 | 0.957576 | 0.975309 | 0.940476 |
| MARCH11 AND CUTA | 0.951807 | 0.963415 | 0.940476 |
| MARCH11 AND SLC38A2 | 0.95122 | 0.975 | 0.928571 |
| MARCH11 AND TOMM7 | 0.946746 | 0.941176 | 0.952381 |
| MARCH11 AND CXCR4 | 0.946746 | 0.941176 | 0.952381 |
| MARCH11 AND NKAIN1 | 0.952381 | 0.952381 | 0.952381 |
| ST8SIA3 AND TMEM258 | 0.957576 | 0.975309 | 0.940476 |
| ST8SIA2 AND ATP5F1 | 0.95 | 1 | 0.904762 |
| ST8SIA2 AND SLC25A3 | 0.956522 | 1 | 0.916667 |
| ST8SIA2 AND SLC38A2 | 0.943396 | 1 | 0.892857 |
| SCN3B AND DCHS1 | 0.952941 | 0.94186 | 0.964286 |
| RTN1 AND DCHS1 | 0.957576 | 0.975309 | 0.940476 |
| ST8SIA2 AND TMEM258 | 0.943396 | 1 | 0.892857 |
| SV2A AND DCHS1 | 0.936416 | 0.910112 | 0.964286 |
| Lymphoma, Mantle-Cell (Mantle-Cell Lymphoma) | | | |
| MS4A1 AND CELSR1 | 0.936709 | 0.902439 | 0.973684 |
| MS4A1 AND QSOX2 | 0.902439 | 0.840909 | 0.973684 |
| TNFRSF13C AND COX7A2 | 0.915663 | 0.844444 | 1 |
| TNFRSF13C AND HLA-DRA | 0.915663 | 0.844444 | 1 |
| TNFRSF13C AND SLC25A3 | 0.915663 | 0.844444 | 1 |
| TNFRSF13C AND HERPUD1 | 0.915663 | 0.844444 | 1 |
| CXCR4 AND CELSR1 | 0.936709 | 0.902439 | 0.973684 |
| MS4A1 AND CELSR1 | 0.936709 | 0.902439 | 0.973684 |
| Sarcoma (Sarcoma) | | | |
| ADAM12 AND JTB | 0.941176 | 0.941176 | 0.941176 |
| ADAM12 AND PLD3 | 0.918919 | 0.85 | 1 |
| ADAM12 AND HLA-B | 0.941176 | 0.941176 | 0.941176 |
| ADAM12 AND HLA-C | 0.914286 | 0.888889 | 0.941176 |
| ADAM12 AND OSTC | 0.914286 | 0.888889 | 0.941176 |
| Carcinoma, Non-Small-Cell Lung (Lung NSCC) | | | |
| OST4 AND SEMA4F | 0.952381 | 1 | 0.909091 |
| ATP6V0C AND PFN2 | 0.9 | 1 | 0.818182 |
| Leukemia, Myeloid, Acute (AML) | | | |
| FLT3 | 0.935223 | 0.950617 | 0.920319 |
| SLC22A16 AND CD44 | 0.914286 | 0.937238 | 0.89243 |
| FUT4 AND CD44 | 0.903955 | 0.857143 | 0.956175 |
| FLT3 AND CD44 | 0.930894 | 0.950207 | 0.912351 |
| HBD AND CD44 | 0.903592 | 0.859712 | 0.952191 |
| CD33 AND SMIM3 | 0.900398 | 0.900398 | 0.900398 |
| FLT3 AND IL13RA2 | 0.935223 | 0.950617 | 0.920319 |
| TSPAN32 AND CXCL8 | 0.931559 | 0.890909 | 0.976096 |
| TSPAN32 AND SPINK2 | 0.930526 | 0.986607 | 0.880478 |
| TSPAN32 AND SMIM3 | 0.954455 | 0.948819 | 0.960159 |
| FLT3 AND RNF19B | 0.938776 | 0.962343 | 0.916335 |

FIG. 6 (cont.)

| Antigen Pair Logic | F1 | Precision | Recall |
|---|---|---|---|
| PTPRZ1 AND SORCS3 | 0.985507 | 0.985507 | 0.985507 |
| PTPRZ1 AND ABCB7 | 0.977778 | 1 | 0.956522 |
| PTPRZ1 AND KLHDC10 | 0.985507 | 0.985507 | 0.985507 |
| PTPRZ1 AND TMCC1 | 0.985507 | 0.985507 | 0.985507 |
| PTPRZ1 AND TBC1D2B | 0.985507 | 0.985507 | 0.985507 |
| PTPRZ1 AND NFASC | 0.985507 | 0.985507 | 0.985507 |
| PTPRZ1 AND PLXND1 | 0.985294 | 1 | 0.971014 |
| PTPRZ1 AND ANKLE2 | 0.992701 | 1 | 0.985507 |
| PTPRZ1 AND GRAMD4 | 0.985507 | 0.985507 | 0.985507 |
| PTPRZ1 AND CLCC1 | 0.977778 | 1 | 0.956522 |
| PTPRZ1 AND STAB1 | 0.985507 | 0.985507 | 0.985507 |
| PTPRZ1 AND SLC35D1 | 0.985507 | 0.985507 | 0.985507 |
| PTPRZ1 AND GANAB | 0.977778 | 1 | 0.956522 |
| PTPRZ1 AND ARL6IP1 | 0.985507 | 0.985507 | 0.985507 |
| SYT11 AND SPCS1 | 0.970149 | 1 | 0.942029 |
| SYT11 AND SLC25A5 | 0.992701 | 1 | 0.985507 |
| SYT11 AND ITGAV | 0.977778 | 1 | 0.956522 |
| SYT11 AND NDUFB5 | 0.977778 | 1 | 0.956522 |
| SYT11 AND TMX2 | 0.970149 | 1 | 0.942029 |
| SYT11 AND TMEM14C | 0.970149 | 1 | 0.942029 |
| SYT11 AND SLC38A2 | 0.977778 | 1 | 0.956522 |
| PTPRZ1 AND SYT11 | 0.985294 | 1 | 0.971014 |
| SYT11 AND SELK | 0.977778 | 1 | 0.956522 |
| SYT11 AND WRB | 0.985507 | 0.985507 | 0.985507 |
| SYT11 AND PTTG1IP | 0.985294 | 1 | 0.971014 |
| SYT11 AND ATP6V0E1 | 0.970149 | 1 | 0.942029 |
| SYT11 AND CD63 | 0.970149 | 1 | 0.942029 |
| PTPRZ1 AND NUP210 | 0.985507 | 0.985507 | 0.985507 |
| PTPRZ1 AND SEL1L3 | 0.985507 | 0.985507 | 0.985507 |
| PTPRZ1 AND ASTN2 | 0.985507 | 0.985507 | 0.985507 |
| PTPRZ1 AND DENND5A | 0.985507 | 0.985507 | 0.985507 |
| PTPRZ1 AND ADGRL3 | 0.985507 | 0.985507 | 0.985507 |
| PTPRZ1 AND FMO3 | 0.985507 | 0.985507 | 0.985507 |
| GPM6B AND NEMP1 | 0.970149 | 1 | 0.942029 |
| PTPRZ1 AND NEMP1 | 0.970149 | 1 | 0.942029 |
| PTPRZ1 AND SLC9A8 | 0.985507 | 0.985507 | 0.985507 |
| PTPRZ1 AND DPY19L1 | 0.985507 | 0.985507 | 0.985507 |
| PTPRZ1 AND SUN1 | 0.985507 | 0.985507 | 0.985507 |
| PTPRZ1 AND NCSTN | 0.970149 | 1 | 0.942029 |
| PTPRZ1 AND CRB1 | 0.985507 | 0.985507 | 0.985507 |
| PTPRZ1 AND GPR161 | 0.985507 | 0.985507 | 0.985507 |
| PTPRZ1 AND SLC35A3 | 0.992701 | 1 | 0.985507 |
| PTPRZ1 AND ABCB10 | 0.992701 | 1 | 0.985507 |
| PTPRZ1 AND TRAM1 | 0.992701 | 1 | 0.985507 |
| GPM6B AND SEC11A | 0.977778 | 1 | 0.956522 |
| PTPRZ1 AND SEC11A | 0.977778 | 1 | 0.956522 |
| GPM6B AND SEC61G | 0.970149 | 1 | 0.942029 |
| GPM6B AND LEPROTL1 | 0.977778 | 1 | 0.956522 |
| PTPRZ1 AND LEPROTL1 | 0.977778 | 1 | 0.956522 |
| PTPRZ1 AND MACF1 | 0.985507 | 0.985507 | 0.985507 |
| PTPRZ1 AND TMEM131 | 0.977778 | 1 | 0.956522 |
| PTPRZ1 AND SLC39A14 | 0.985507 | 0.985507 | 0.985507 |
| PTPRZ1 AND NNT | 0.985507 | 0.985507 | 0.985507 |
| PTPRZ1 AND MMD | 0.985507 | 0.985507 | 0.985507 |

| Antigen Pair Logic | F1 | Precision | Recall |
|---|---|---|---|
| FLT3 AND CD46 | 0.931677 | 0.969828 | 0.896414 |
| FUT4 AND DENND5A | 0.948617 | 0.941176 | 0.956175 |
| FUT4 AND C16orf54 | 0.937743 | 0.91635 | 0.960159 |
| FUT4 AND P2RY8 | 0.937743 | 0.91635 | 0.960159 |
| FUT4 AND HBD | 0.937984 | 0.913208 | 0.964143 |
| FUT4 AND CXCL8 | 0.958084 | 0.96 | 0.956175 |
| P2RX1 AND FUT4 | 0.93666 | 0.903704 | 0.972112 |
| P2RX1 AND CXCL8 | 0.93617 | 0.909774 | 0.964143 |
| SMIM3 AND CXCL8 | 0.939571 | 0.919847 | 0.960159 |
| P2RX1 AND SPINK2 | 0.929461 | 0.969697 | 0.89243 |
| Stomach Neoplasms\|Adenocarcinoma (Stomach A) | | | |
| MUC13 AND APOLD1 | 0.911111 | 0.87234 | 0.953488 |
| GREM1 AND MUC13 | 0.926829 | 0.974359 | 0.883721 |
| GREM1 AND TNFRSF10B | 0.915663 | 0.95 | 0.883721 |
| GREM1 AND MUC1 | 0.91358 | 0.973684 | 0.860465 |
| GREM1 AND KCNE3 | 0.938272 | 1 | 0.883721 |
| GREM1 AND ATP9A | 0.9 | 0.972973 | 0.837209 |
| GREM1 AND TSPAN1 | 0.915663 | 0.95 | 0.883721 |
| GREM1 AND PDZK1IP1 | 0.904762 | 0.926829 | 0.883721 |
| GREM1 AND ADAM8 | 0.915663 | 0.95 | 0.883721 |
| GREM1 AND ZMPSTE24 | 0.938272 | 1 | 0.883721 |
| GREM1 AND PRSS16 | 0.904762 | 0.926829 | 0.883721 |
| GREM1 AND LILRB2 | 0.926829 | 0.974359 | 0.883721 |
| GREM1 AND B3GNT3 | 0.926829 | 0.974359 | 0.883721 |
| GREM1 AND LYPLA1 | 0.925 | 1 | 0.860465 |
| GREM1 AND HTATIP2 | 0.911392 | 1 | 0.837209 |
| GREM1 AND AGPAT2 | 0.938272 | 1 | 0.883721 |
| GREM1 AND TNFSF13B | 0.938272 | 1 | 0.883721 |
| GREM1 AND SLC12A7 | 0.911392 | 1 | 0.837209 |
| GREM1 AND ADAM28 | 0.902439 | 0.948718 | 0.860465 |
| GRIN2D AND JTB | 0.909091 | 0.888889 | 0.930233 |
| GREM1 AND AFG3L2 | 0.938272 | 1 | 0.883721 |
| GREM1 AND SLC35D2 | 0.938272 | 1 | 0.883721 |
| GREM1 AND GALNT6 | 0.925 | 1 | 0.860465 |
| GREM1 AND GLMP | 0.925 | 1 | 0.860465 |
| GREM1 AND MGAT4B | 0.938272 | 1 | 0.883721 |
| GREM1 AND MGAT4A | 0.911392 | 1 | 0.837209 |
| GREM1 AND TMC6 | 0.904762 | 0.926829 | 0.883721 |
| GREM1 AND MAL2 | 0.915663 | 0.95 | 0.883721 |
| GREM1 AND SLC18B1 | 0.938272 | 1 | 0.883721 |
| GREM1 AND CLCN5 | 0.904762 | 0.926829 | 0.883721 |
| GREM1 AND ZFYVE27 | 0.926829 | 0.974359 | 0.883721 |
| GREM1 AND SFXN4 | 0.925 | 1 | 0.860465 |
| GREM1 AND TMEM45B | 0.915663 | 0.95 | 0.883721 |
| GREM1 AND CLPTM1 | 0.904762 | 0.926829 | 0.883721 |
| GREM1 AND NIPA1 | 0.904762 | 0.926829 | 0.883721 |
| GREM1 AND TMEM219 | 0.926829 | 0.974359 | 0.883721 |
| GREM1 AND CANT1 | 0.938272 | 1 | 0.883721 |
| GREM1 AND SLC44A3 | 0.926829 | 0.974359 | 0.883721 |
| GREM1 AND TMEM125 | 0.915663 | 0.95 | 0.883721 |
| GREM1 AND COX8A | 0.926829 | 0.974359 | 0.883721 |
| GREM1 AND CLDN4 | 0.915663 | 0.95 | 0.883721 |
| GREM1 AND CMTM4 | 0.926829 | 0.974359 | 0.883721 |
| GREM1 AND TMC4 | 0.926829 | 0.974359 | 0.883721 |

FIG. 6 (cont.)

| Antigen Pair Logic | F1 | Precision | Recall |
|---|---|---|---|
| PTPRZ1 AND SEZ6L | 0.985507 | 0.985507 | 0.985507 |
| PTPRZ1 AND ATP6V0A2 | 0.985507 | 0.985507 | 0.985507 |
| PTPRZ1 AND TSPAN12 | 0.985507 | 0.985507 | 0.985507 |
| PTPRZ1 AND PIGN | 0.985507 | 0.985507 | 0.985507 |
| PTPRZ1 AND CLDN14 | 0.985507 | 0.985507 | 0.985507 |
| PTPRZ1 AND FPR1 | 0.985507 | 0.985507 | 0.985507 |
| PTPRZ1 AND LEMD3 | 0.992701 | 1 | 0.985507 |
| PTPRZ1 AND FPR3 | 0.985507 | 0.985507 | 0.985507 |
| PTPRZ1 AND CLEC5A | 0.985507 | 0.985507 | 0.985507 |
| PTPRZ1 AND KCNE5 | 0.985507 | 0.985507 | 0.985507 |
| PTPRZ1 AND CA14 | 0.985507 | 0.985507 | 0.985507 |
| PTPRZ1 AND RABGAP1 | 0.985507 | 0.985507 | 0.985507 |
| PTPRZ1 AND PLD3 | 0.985507 | 0.985507 | 0.985507 |
| PTPRZ1 AND KCNE4 | 0.985507 | 0.985507 | 0.985507 |
| PTPRZ1 AND SDF2L1 | 0.985507 | 0.985507 | 0.985507 |
| PTPRZ1 AND IL17RA | 0.985507 | 0.985507 | 0.985507 |
| PTPRZ1 AND FLRT1 | 0.985507 | 0.985507 | 0.985507 |
| PTPRZ1 AND BCL2L13 | 0.985507 | 0.985507 | 0.985507 |
| PTPRZ1 AND PANX1 | 0.992701 | 1 | 0.985507 |
| PTPRZ1 AND CLDN15 | 0.985507 | 0.985507 | 0.985507 |
| PTPRZ1 AND FJX1 | 0.977778 | 1 | 0.956522 |
| PTPRZ1 AND ALOX5AP | 0.985507 | 0.985507 | 0.985507 |
| PTPRZ1 AND FUT4 | 0.985507 | 0.985507 | 0.985507 |
| PTPRZ1 AND HEPACAM2 | 0.985507 | 0.985507 | 0.985507 |
| PTPRZ1 AND TECRL | 0.985507 | 0.985507 | 0.985507 |
| PTPRZ1 AND KDSR | 0.985507 | 0.985507 | 0.985507 |
| PTPRZ1 AND LCLAT1 | 0.970149 | 1 | 0.942029 |
| PTPRZ1 AND FZD2 | 0.985507 | 0.985507 | 0.985507 |
| PTPRZ1 AND CERS6 | 0.992701 | 1 | 0.985507 |
| PTPRZ1 AND ZDHHC24 | 0.985507 | 0.985507 | 0.985507 |
| PTPRZ1 AND TMEM256 | 0.985507 | 0.985507 | 0.985507 |
| PTPRZ1 AND INAFM1 | 0.985507 | 0.985507 | 0.985507 |
| PTPRZ1 AND CNEP1R1 | 0.985507 | 0.985507 | 0.985507 |
| PTPRZ1 AND SYT14 | 0.985507 | 0.985507 | 0.985507 |
| PTPRZ1 AND GABRB1 | 0.985507 | 0.985507 | 0.985507 |
| PTPRZ1 AND GABRG3 | 0.985507 | 0.985507 | 0.985507 |
| PTPRZ1 AND SERINC5 | 0.985507 | 0.985507 | 0.985507 |
| PTPRZ1 AND FRMD3 | 0.985507 | 0.985507 | 0.985507 |
| PTPRZ1 AND TMEM59L | 0.985507 | 0.985507 | 0.985507 |
| GPM6B AND BRI3 | 0.977778 | 1 | 0.956522 |
| PTPRZ1 AND BRI3 | 0.985294 | 1 | 0.971014 |
| PTPRZ1 AND SLC39A6 | 0.970149 | 1 | 0.942029 |
| PTPRZ1 AND BAMBI | 0.985507 | 0.985507 | 0.985507 |
| PTPRZ1 AND RHBDD3 | 0.985507 | 0.985507 | 0.985507 |
| PTPRZ1 AND METTL7A | 0.985507 | 0.985507 | 0.985507 |
| PTPRZ1 AND YIPF3 | 0.970149 | 1 | 0.942029 |
| PTPRZ1 AND GALR1 | 0.985507 | 0.985507 | 0.985507 |
| PTPRZ1 AND TMEM186 | 0.985507 | 0.985507 | 0.985507 |
| PTPRZ1 AND RNF19A | 0.985507 | 0.985507 | 0.985507 |
| GPM6B AND GALNT1 | 0.992701 | 1 | 0.985507 |
| PTPRZ1 AND GALNT1 | 0.992701 | 1 | 0.985507 |
| PTPRZ1 AND OLFML2B | 0.985507 | 0.985507 | 0.985507 |
| PTPRZ1 AND TMEM158 | 0.985507 | 0.985507 | 0.985507 |
| PTPRZ1 AND C1orf43 | 0.970149 | 1 | 0.942029 |

| Antigen Pair Logic | F1 | Precision | Recall |
|---|---|---|---|
| GREM1 AND CXADR | 0.904762 | 0.926829 | 0.883721 |
| GREM1 AND TMEM161B | 0.926829 | 0.974359 | 0.883721 |
| GREM1 AND RDH10 | 0.926829 | 0.974359 | 0.883721 |
| GREM1 AND CYP3A5 | 0.915663 | 0.95 | 0.883721 |
| GREM1 AND ABHD3 | 0.925 | 1 | 0.860465 |
| GREM1 AND DPAGT1 | 0.938272 | 1 | 0.883721 |
| GREM1 AND DSG2 | 0.938272 | 1 | 0.883721 |
| GREM1 AND KRTCAP3 | 0.925 | 1 | 0.860465 |
| GREM1 AND TIGIT | 0.904762 | 0.926829 | 0.883721 |
| GREM1 AND EPHA1 | 0.904762 | 0.926829 | 0.883721 |
| GREM1 AND ERN1 | 0.9 | 0.972973 | 0.837209 |
| GREM1 AND EVI2A | 0.915663 | 0.95 | 0.883721 |
| GREM1 AND EVI2B | 0.904762 | 0.926829 | 0.883721 |
| GREM1 AND F2RL1 | 0.926829 | 0.974359 | 0.883721 |
| GREM1 AND MPEG1 | 0.926829 | 0.974359 | 0.883721 |
| GREM1 AND FCER1G | 0.925 | 1 | 0.860465 |
| GREM1 AND C6orf136 | 0.926829 | 0.974359 | 0.883721 |
| GREM1 AND FCGR3B | 0.911392 | 1 | 0.837209 |
| GREM1 AND TMED4 | 0.911392 | 1 | 0.837209 |
| GREM1 AND UNC5CL | 0.915663 | 0.95 | 0.883721 |
| GREM1 AND CD93 | 0.91358 | 0.973684 | 0.860465 |
| GREM1 AND NUP210 | 0.926829 | 0.974359 | 0.883721 |
| GREM1 AND SEL1L3 | 0.938272 | 1 | 0.883721 |
| GREM1 AND ATP11A | 0.902439 | 0.948718 | 0.860465 |
| GREM1 AND FMO5 | 0.9 | 0.972973 | 0.837209 |
| GREM1 AND SLC9A8 | 0.904762 | 0.926829 | 0.883721 |
| GREM1 AND SLC35A3 | 0.926829 | 0.974359 | 0.883721 |
| GREM1 AND TRAM1 | 0.911392 | 1 | 0.837209 |
| GREM1 AND SEC61G | 0.926829 | 0.974359 | 0.883721 |
| GREM1 AND VSIG2 | 0.9 | 0.972973 | 0.837209 |
| GREM1 AND LEMD3 | 0.925 | 1 | 0.860465 |
| GREM1 AND PLD3 | 0.926829 | 0.974359 | 0.883721 |
| GREM1 AND TMEM2 | 0.938272 | 1 | 0.883721 |
| GREM1 AND ALOX5AP | 0.925 | 1 | 0.860465 |
| GREM1 AND FUT2 | 0.904762 | 0.926829 | 0.883721 |
| GREM1 AND FUT4 | 0.938272 | 1 | 0.883721 |
| GREM1 AND FUT8 | 0.91358 | 0.973684 | 0.860465 |
| GREM1 AND CERS6 | 0.926829 | 0.974359 | 0.883721 |
| GREM1 AND IFI6 | 0.911392 | 1 | 0.837209 |
| GREM1 AND ZDHHC23 | 0.926829 | 0.974359 | 0.883721 |
| GREM1 AND GALNT3 | 0.938272 | 1 | 0.883721 |
| GREM1 AND IL4I1 | 0.904762 | 0.926829 | 0.883721 |
| GREM1 AND PVRL3 | 0.9 | 0.972973 | 0.837209 |
| GREM1 AND PNKD | 0.911392 | 1 | 0.837209 |
| GREM1 AND STEAP2 | 0.915663 | 0.95 | 0.883721 |
| GREM1 AND KCNG2 | 0.904762 | 0.926829 | 0.883721 |
| GREM1 AND CLEC4E | 0.902439 | 0.948718 | 0.860465 |
| GREM1 AND CNNM4 | 0.915663 | 0.95 | 0.883721 |
| GREM1 AND STEAP1 | 0.915663 | 0.95 | 0.883721 |
| GREM1 AND GPR160 | 0.938272 | 1 | 0.883721 |
| GREM1 AND CNPPD1 | 0.926829 | 0.974359 | 0.883721 |
| GREM1 AND GJB1 | 0.926829 | 0.974359 | 0.883721 |
| GREM1 AND GOLGB1 | 0.911392 | 1 | 0.837209 |
| GREM1 AND B4GALNT3 | 0.904762 | 0.926829 | 0.883721 |

FIG. 6 (cont.)

| Antigen Pair Logic | F1 | Precision | Recall |
|---|---|---|---|
| GPM6B AND ZDHHC5 | 0.985294 | 1 | 0.971014 |
| PTPRZ1 AND ZDHHC5 | 0.985294 | 1 | 0.971014 |
| PTPRZ1 AND TMIE | 0.985507 | 0.985507 | 0.985507 |
| PTPRZ1 AND PVRL3 | 0.985507 | 0.985507 | 0.985507 |
| PTPRZ1 AND UNC5D | 0.985507 | 0.985507 | 0.985507 |
| PTPRZ1 AND DHRS7B | 0.970149 | 1 | 0.942029 |
| PTPRZ1 AND RNF167 | 0.985507 | 0.985507 | 0.985507 |
| PTPRZ1 AND TENM4 | 0.985507 | 0.985507 | 0.985507 |
| PTPRZ1 AND LRP10 | 0.985507 | 0.985507 | 0.985507 |
| PTPRZ1 AND SUSD5 | 0.985507 | 0.985507 | 0.985507 |
| PTPRZ1 AND ATRNL1 | 0.985507 | 0.985507 | 0.985507 |
| GPM6B AND TCTN3 | 0.970149 | 1 | 0.942029 |
| PTPRZ1 AND TCTN3 | 0.977778 | 1 | 0.956522 |
| PTPRZ1 AND LRRC32 | 0.985507 | 0.985507 | 0.985507 |
| PTPRZ1 AND PCDHB5 | 0.985507 | 0.985507 | 0.985507 |
| GPM6B AND TMEM251 | 0.977778 | 1 | 0.956522 |
| PTPRZ1 AND TMEM251 | 0.977778 | 1 | 0.956522 |
| PTPRZ1 AND OR1C1 | 0.985507 | 0.985507 | 0.985507 |
| PTPRZ1 AND OR1A2 | 0.985507 | 0.985507 | 0.985507 |
| PTPRZ1 AND OR2B6 | 0.985507 | 0.985507 | 0.985507 |
| PTPRZ1 AND B3GAT3 | 0.992701 | 1 | 0.985507 |
| PTPRZ1 AND CLEC4E | 0.985507 | 0.985507 | 0.985507 |
| PTPRZ1 AND GBGT1 | 0.985507 | 0.985507 | 0.985507 |
| PTPRZ1 AND SEZ6L2 | 0.985507 | 0.985507 | 0.985507 |
| PTPRZ1 AND OR10J1 | 0.985507 | 0.985507 | 0.985507 |
| PTPRZ1 AND SLC17A5 | 0.985507 | 0.985507 | 0.985507 |
| PTPRZ1 AND CNNM3 | 0.985507 | 0.985507 | 0.985507 |
| PTPRZ1 AND MYOF | 0.985507 | 0.985507 | 0.985507 |
| PTPRZ1 AND CHIC2 | 0.977778 | 1 | 0.956522 |
| PTPRZ1 AND TBL2 | 0.992701 | 1 | 0.985507 |
| PTPRZ1 AND GGCX | 0.985507 | 0.985507 | 0.985507 |
| PTPRZ1 AND GGT5 | 0.970149 | 1 | 0.942029 |
| PTPRZ1 AND GJA1 | 0.985507 | 0.985507 | 0.985507 |
| PTPRZ1 AND GPR160 | 0.985507 | 0.985507 | 0.985507 |
| PTPRZ1 AND GJA3 | 0.985507 | 0.985507 | 0.985507 |
| PTPRZ1 AND SIGLEC7 | 0.985507 | 0.985507 | 0.985507 |
| PTPRZ1 AND GHITM | 0.985507 | 0.985507 | 0.985507 |
| PTPRZ1 AND B3GAT1 | 0.985507 | 0.985507 | 0.985507 |
| PTPRZ1 AND ST6GALNAC4 | 0.985507 | 0.985507 | 0.985507 |
| PTPRZ1 AND CACNG4 | 0.985507 | 0.985507 | 0.985507 |
| PTPRZ1 AND SLC39A1 | 0.985294 | 1 | 0.971014 |
| PTPRZ1 AND SIGLEC8 | 0.985507 | 0.985507 | 0.985507 |
| PTPRZ1 AND GPR82 | 0.985507 | 0.985507 | 0.985507 |
| GPM6B AND SERP1 | 0.985294 | 1 | 0.971014 |
| PTPRZ1 AND SERP1 | 0.985294 | 1 | 0.971014 |
| PTPRZ1 AND COQ2 | 0.985294 | 1 | 0.971014 |
| PTPRZ1 AND TNFRSF21 | 0.977778 | 1 | 0.956522 |
| PTPRZ1 AND PCDH17 | 0.985507 | 0.985507 | 0.985507 |
| PTPRZ1 AND GOLIM4 | 0.985507 | 0.985507 | 0.985507 |
| PTPRZ1 AND PCSK1N | 0.985507 | 0.985507 | 0.985507 |
| PTPRZ1 AND KCNMB4 | 0.985507 | 0.985507 | 0.985507 |
| GPM6B AND TOR1B | 0.970149 | 1 | 0.942029 |
| PTPRZ1 AND TOR1B | 0.985294 | 1 | 0.971014 |
| PTPRZ1 AND GLG1 | 0.985507 | 0.985507 | 0.985507 |

| Antigen Pair Logic | F1 | Precision | Recall |
|---|---|---|---|
| GREM1 AND TMEM176B | 0.915663 | 0.95 | 0.883721 |
| GREM1 AND CYP2S1 | 0.915663 | 0.95 | 0.883721 |
| GREM1 AND DPP7 | 0.925 | 1 | 0.860465 |
| GREM1 AND HLA-DOA | 0.904762 | 0.926829 | 0.883721 |
| GREM1 AND HLA-DRA | 0.911392 | 1 | 0.837209 |
| GREM1 AND HLA-F | 0.926829 | 0.974359 | 0.883721 |
| GREM1 AND HSD17B2 | 0.915663 | 0.95 | 0.883721 |
| GREM1 AND ANO9 | 0.904762 | 0.926829 | 0.883721 |
| GREM1 AND SERINC2 | 0.938272 | 1 | 0.883721 |
| GREM1 AND IL7R | 0.938272 | 1 | 0.883721 |
| GREM1 AND IL13 | 0.904762 | 0.926829 | 0.883721 |
| GREM1 AND INPP4A | 0.926829 | 0.974359 | 0.883721 |
| GREM1 AND INSR | 0.926829 | 0.974359 | 0.883721 |
| GREM1 AND ITGA6 | 0.925 | 1 | 0.860465 |
| GREM1 AND ITGAM | 0.911392 | 1 | 0.837209 |
| GREM1 AND ITGAX | 0.904762 | 0.926829 | 0.883721 |
| GREM1 AND ITGB2 | 0.938272 | 1 | 0.883721 |
| GREM1 AND ITPR3 | 0.938272 | 1 | 0.883721 |
| GREM1 AND TMEM205 | 0.926829 | 0.974359 | 0.883721 |
| GREM1 AND KCNK1 | 0.911392 | 1 | 0.837209 |
| GREM1 AND KCNN4 | 0.91358 | 0.973684 | 0.860465 |
| GREM1 AND KCNQ1 | 0.926829 | 0.974359 | 0.883721 |
| GREM1 AND TMEM189 | 0.915663 | 0.95 | 0.883721 |
| GREM1 AND LAMP1 | 0.91358 | 0.973684 | 0.860465 |
| GREM1 AND EPCAM | 0.938272 | 1 | 0.883721 |
| GREM1 AND MGST2 | 0.926829 | 0.974359 | 0.883721 |
| GREM1 AND ABCC1 | 0.915663 | 0.95 | 0.883721 |
| GREM1 AND SMIM22 | 0.925 | 1 | 0.860465 |
| GREM1 AND MST1R | 0.926829 | 0.974359 | 0.883721 |
| GREM1 AND MTHFD1 | 0.938272 | 1 | 0.883721 |
| GREM1 AND MUC1 | 0.91358 | 0.973684 | 0.860465 |
| GREM1 AND MUC3A | 0.904762 | 0.926829 | 0.883721 |
| GREM1 AND ATP2A3 | 0.904762 | 0.926829 | 0.883721 |
| GREM1 AND NTRK1 | 0.91358 | 0.973684 | 0.860465 |
| GREM1 AND NUCB1 | 0.904762 | 0.926829 | 0.883721 |
| GREM1 AND P2RX4 | 0.926829 | 0.974359 | 0.883721 |
| GREM1 AND F11R | 0.926829 | 0.974359 | 0.883721 |
| GREM1 AND TMX2 | 0.925 | 1 | 0.860465 |
| GREM1 AND SLC15A3 | 0.904762 | 0.926829 | 0.883721 |
| GREM1 AND LSR | 0.926829 | 0.974359 | 0.883721 |
| GREM1 AND PIGT | 0.925 | 1 | 0.860465 |
| GREM1 AND TMBIM4 | 0.911392 | 1 | 0.837209 |
| GREM1 AND ACSL5 | 0.911392 | 1 | 0.837209 |
| GREM1 AND GALNT7 | 0.938272 | 1 | 0.883721 |
| GREM1 AND CECR1 | 0.91358 | 0.973684 | 0.860465 |
| GREM1 AND SERPINA1 | 0.926829 | 0.974359 | 0.883721 |
| GREM1 AND PLXNA1 | 0.904762 | 0.926829 | 0.883721 |
| GREM1 AND ATP6AP1 | 0.938272 | 1 | 0.883721 |
| GREM1 AND PODXL | 0.9 | 0.972973 | 0.837209 |
| GREM1 AND POR | 0.938272 | 1 | 0.883721 |
| GREM1 AND VSIG10 | 0.904762 | 0.926829 | 0.883721 |
| GREM1 AND P4HTM | 0.926829 | 0.974359 | 0.883721 |
| GREM1 AND TRPM4 | 0.926829 | 0.974359 | 0.883721 |
| GREM1 AND CDHR2 | 0.938272 | 1 | 0.883721 |

FIG. 6 (cont.)

| Antigen Pair Logic | F1 | Precision | Recall |
|---|---|---|---|
| PTPRZ1 AND GLRA2 | 0.985507 | 0.985507 | 0.985507 |
| PTPRZ1 AND CECR6 | 0.985507 | 0.985507 | 0.985507 |
| PTPRZ1 AND GNS | 0.992701 | 1 | 0.985507 |
| PTPRZ1 AND GOLGB1 | 0.970149 | 1 | 0.942029 |
| PTPRZ1 AND SLCO1B3 | 0.985507 | 0.985507 | 0.985507 |
| GPM6A AND SPCS1 | 0.970149 | 1 | 0.942029 |
| GPM6A AND ATRAID | 0.985294 | 1 | 0.971014 |
| GPM6A AND TMEM14C | 0.970149 | 1 | 0.942029 |
| GPM6A AND ATP5F1 | 0.985294 | 1 | 0.971014 |
| GPM6A AND SLC38A2 | 0.977778 | 1 | 0.956522 |
| PTPRZ1 AND GPM6A | 0.985507 | 0.985507 | 0.985507 |
| GPM6A AND PTTG1IP | 0.985294 | 1 | 0.971014 |
| GPM6A AND ATP6V0E1 | 0.970149 | 1 | 0.942029 |
| GPM6A AND CD63 | 0.992701 | 1 | 0.985507 |
| GPM6A AND LAPTM4A | 0.992701 | 1 | 0.985507 |
| GPM6B AND SPCS1 | 0.970149 | 1 | 0.942029 |
| GPM6B AND TMEM208 | 0.985294 | 1 | 0.971014 |
| GPM6B AND ALG5 | 0.970149 | 1 | 0.942029 |
| GPM6B AND SEC61A1 | 0.970149 | 1 | 0.942029 |
| GPM6B AND ITGAE | 0.985294 | 1 | 0.971014 |
| GPM6B AND SMIM20 | 0.970149 | 1 | 0.942029 |
| GPM6B AND MFAP3 | 0.977778 | 1 | 0.956522 |
| GPM6B AND OXA1L | 0.992701 | 1 | 0.985507 |
| GPM6B AND TMED5 | 0.985294 | 1 | 0.971014 |
| GPM6B AND DERL2 | 0.977778 | 1 | 0.956522 |
| GPM6B AND GOLT1B | 0.970149 | 1 | 0.942029 |
| GPM6B AND IER3IP1 | 0.985294 | 1 | 0.971014 |
| GPM6B AND TMEM69 | 0.985294 | 1 | 0.971014 |
| GPM6B AND WDR83OS | 0.985294 | 1 | 0.971014 |
| GPM6B AND UBE2J1 | 0.977778 | 1 | 0.956522 |
| GPM6B AND TMEM138 | 0.985294 | 1 | 0.971014 |
| GPM6B AND CUTA | 0.970149 | 1 | 0.942029 |
| GPM6B AND ATP5F1 | 0.985294 | 1 | 0.971014 |
| GPM6B AND PIGC | 0.977778 | 1 | 0.956522 |
| GPM6B AND PIGF | 0.977778 | 1 | 0.956522 |
| GPM6B AND ACP1 | 0.977778 | 1 | 0.956522 |
| GPM6B AND STX18 | 0.970149 | 1 | 0.942029 |
| GPM6B AND TMCO1 | 0.970149 | 1 | 0.942029 |
| GPM6B AND IMPAD1 | 0.970149 | 1 | 0.942029 |
| GPM6B AND PRCP | 0.970149 | 1 | 0.942029 |
| GPM6B AND PARL | 0.977778 | 1 | 0.956522 |
| GPM6B AND ETNK1 | 0.970149 | 1 | 0.942029 |
| GPM6B AND SLC30A6 | 0.977778 | 1 | 0.956522 |
| GPM6B AND VIMP | 0.985294 | 1 | 0.971014 |
| GPM6B AND EMC3 | 0.977778 | 1 | 0.956522 |
| GPM6B AND PLGRKT | 0.970149 | 1 | 0.942029 |
| GPM6B AND DIABLO | 0.992701 | 1 | 0.985507 |
| GPM6B AND C5orf15 | 0.970149 | 1 | 0.942029 |
| GPM6B AND MAVS | 0.970149 | 1 | 0.942029 |
| PTPRZ1 AND GPM6B | 0.985507 | 0.985507 | 0.985507 |
| GPM6B AND PEX2 | 0.970149 | 1 | 0.942029 |
| GPM6B AND SELK | 0.977778 | 1 | 0.956522 |
| GPM6B AND SRR | 0.977778 | 1 | 0.956522 |
| GPM6B AND C5orf28 | 0.970149 | 1 | 0.942029 |

| Antigen Pair Logic | F1 | Precision | Recall |
|---|---|---|---|
| GREM1 AND RETSAT | 0.915663 | 0.95 | 0.883721 |
| GREM1 AND TMEM248 | 0.938272 | 1 | 0.883721 |
| GREM1 AND TAPBPL | 0.904762 | 0.926829 | 0.883721 |
| GREM1 AND TMEM51 | 0.915663 | 0.95 | 0.883721 |
| GREM1 AND ZDHHC4 | 0.91358 | 0.973684 | 0.860465 |
| GREM1 AND TMEM57 | 0.9 | 0.972973 | 0.837209 |
| GREM1 AND IL17RB | 0.902439 | 0.948718 | 0.860465 |
| GREM1 AND SLC39A4 | 0.926829 | 0.974359 | 0.883721 |
| GREM1 AND CARKD | 0.902439 | 0.948718 | 0.860465 |
| GREM1 AND ST6GALNAC1 | 0.938272 | 1 | 0.883721 |
| GREM1 AND LRRC8A | 0.904762 | 0.926829 | 0.883721 |
| GREM1 AND TMPRSS4 | 0.904762 | 0.926829 | 0.883721 |
| GREM1 AND MUC13 | 0.926829 | 0.974359 | 0.883721 |
| GREM1 AND SLAMF8 | 0.904762 | 0.926829 | 0.883721 |
| GREM1 AND C1GALT1 | 0.911392 | 1 | 0.837209 |
| GREM1 AND ATP13A1 | 0.926829 | 0.974359 | 0.883721 |
| GREM1 AND SLC45A4 | 0.925 | 1 | 0.860465 |
| GREM1 AND SYT13 | 0.91358 | 0.973684 | 0.860465 |
| GREM1 AND SEMA4G | 0.926829 | 0.974359 | 0.883721 |
| GREM1 AND PTPRCAP | 0.904762 | 0.926829 | 0.883721 |
| GREM1 AND PTPRE | 0.926829 | 0.974359 | 0.883721 |
| GREM1 AND PTPRH | 0.925 | 1 | 0.860465 |
| GREM1 AND PTPRK | 0.938272 | 1 | 0.883721 |
| GREM1 AND CXCL16 | 0.925 | 1 | 0.860465 |
| GREM1 AND PVRL2 | 0.904762 | 0.926829 | 0.883721 |
| GREM1 AND BCL2L1 | 0.915663 | 0.95 | 0.883721 |
| GREM1 AND RNASE6 | 0.926829 | 0.974359 | 0.883721 |
| GREM1 AND RPN2 | 0.911392 | 1 | 0.837209 |
| GREM1 AND CEACAM1 | 0.902439 | 0.948718 | 0.860465 |
| GREM1 AND SDC4 | 0.911392 | 1 | 0.837209 |
| GREM1 AND BIK | 0.938272 | 1 | 0.883721 |
| GREM1 AND ABCG4 | 0.902439 | 0.948718 | 0.860465 |
| GREM1 AND EDDM3B | 0.926829 | 0.974359 | 0.883721 |
| GREM1 AND DNAJC1 | 0.926829 | 0.974359 | 0.883721 |
| GREM1 AND CYP3A43 | 0.904762 | 0.926829 | 0.883721 |
| GREM1 AND SLC4A2 | 0.926829 | 0.974359 | 0.883721 |
| GREM1 AND SLC12A2 | 0.911392 | 1 | 0.837209 |
| GREM1 AND SLC16A1 | 0.91358 | 0.973684 | 0.860465 |
| GREM1 AND SLC20A1 | 0.911392 | 1 | 0.837209 |
| GREM1 AND SPAG4 | 0.915663 | 0.95 | 0.883721 |
| GREM1 AND SPI1 | 0.915663 | 0.95 | 0.883721 |
| GREM1 AND SPINT1 | 0.904762 | 0.926829 | 0.883721 |
| GREM1 AND ST14 | 0.91358 | 0.973684 | 0.860465 |
| GREM1 AND STX3 | 0.925 | 1 | 0.860465 |
| GREM1 AND TAPBP | 0.915663 | 0.95 | 0.883721 |
| GREM1 AND TLR2 | 0.911392 | 1 | 0.837209 |
| GREM1 AND TSPAN8 | 0.915663 | 0.95 | 0.883721 |
| GREM1 AND TMPRSS2 | 0.915663 | 0.95 | 0.883721 |
| GREM1 AND TNFRSF1B | 0.904762 | 0.926829 | 0.883721 |
| GREM1 AND C1QB | 0.915663 | 0.95 | 0.883721 |
| GREM1 AND TYROBP | 0.915663 | 0.95 | 0.883721 |
| GREM1 AND UGT8 | 0.904762 | 0.926829 | 0.883721 |
| GREM1 AND XK | 0.902439 | 0.948718 | 0.860465 |
| GREM1 AND FZD5 | 0.91358 | 0.973684 | 0.860465 |

FIG. 6 (cont.)

| Antigen Pair Logic | F1 | Precision | Recall |
|---|---|---|---|
| GPM6B AND SLC30A5 | 0.985294 | 1 | 0.971014 |
| GPM6B AND BNIP2 | 0.985507 | 0.985507 | 0.985507 |
| GPM6B AND SOAT1 | 0.970149 | 1 | 0.942029 |
| GPM6B AND SSR2 | 0.970149 | 1 | 0.942029 |
| GPM6B AND HSPA13 | 0.992701 | 1 | 0.985507 |
| GPM6B AND TMBIM6 | 0.970149 | 1 | 0.942029 |
| GPM6B AND PTTG1IP | 0.985294 | 1 | 0.971014 |
| GPM6B AND ZNF7 | 0.970149 | 1 | 0.942029 |
| GPM6B AND ALG8 | 0.985294 | 1 | 0.971014 |
| GPM6B AND DERL1 | 0.977778 | 1 | 0.956522 |
| GPM6B AND TTC13 | 0.970149 | 1 | 0.942029 |
| GPM6B AND KIAA1715 | 0.970149 | 1 | 0.942029 |
| GPM6B AND CANX | 0.970149 | 1 | 0.942029 |
| GPM6B AND SPNS1 | 0.985294 | 1 | 0.971014 |
| GPM6B AND TMEM126A | 0.970149 | 1 | 0.942029 |
| GPM6B AND SLC37A3 | 0.970149 | 1 | 0.942029 |
| GPM6B AND JAGN1 | 0.977778 | 1 | 0.956522 |
| GPM6B AND ZNF559 | 0.977778 | 1 | 0.956522 |
| GPM6B AND ATP6V0E1 | 0.970149 | 1 | 0.942029 |
| GPM6B AND XPR1 | 0.970149 | 1 | 0.942029 |
| GPM6B AND ORMDL1 | 0.970149 | 1 | 0.942029 |
| GPM6B AND TMEM203 | 0.985294 | 1 | 0.971014 |
| GPM6B AND CDYL | 0.970149 | 1 | 0.942029 |
| GPM6B AND STX8 | 0.970149 | 1 | 0.942029 |
| PTPRZ1 AND IFNL2 | 0.985507 | 0.985507 | 0.985507 |
| PTPRZ1 AND NPBWR1 | 0.985507 | 0.985507 | 0.985507 |
| PTPRZ1 AND TMEM80 | 0.985507 | 0.985507 | 0.985507 |
| PTPRZ1 AND SLC22A24 | 0.985507 | 0.985507 | 0.985507 |
| PTPRZ1 AND CD163L1 | 0.985507 | 0.985507 | 0.985507 |
| PTPRZ1 AND DPY19L2 | 0.985507 | 0.985507 | 0.985507 |
| PTPRZ1 AND GXYLT1 | 0.985507 | 0.985507 | 0.985507 |
| PTPRZ1 AND PRLHR | 0.985507 | 0.985507 | 0.985507 |
| PTPRZ1 AND GPR137C | 0.985507 | 0.985507 | 0.985507 |
| PTPRZ1 AND ZDHHC22 | 0.985507 | 0.985507 | 0.985507 |
| PTPRZ1 AND UTS2R | 0.985507 | 0.985507 | 0.985507 |
| PTPRZ1 AND C16orf91 | 0.985294 | 1 | 0.971014 |
| PTPRZ1 AND MILR1 | 0.985507 | 0.985507 | 0.985507 |
| PTPRZ1 AND GPR17 | 0.985507 | 0.985507 | 0.985507 |
| PTPRZ1 AND SLC26A11 | 0.977778 | 1 | 0.956522 |
| PTPRZ1 AND GDPD1 | 0.985507 | 0.985507 | 0.985507 |
| PTPRZ1 AND TMEM145 | 0.985507 | 0.985507 | 0.985507 |
| PTPRZ1 AND TMEM150B | 0.992701 | 1 | 0.985507 |
| PTPRZ1 AND LPAR4 | 0.985507 | 0.985507 | 0.985507 |
| PTPRZ1 AND SIRPB2 | 0.985507 | 0.985507 | 0.985507 |
| PTPRZ1 AND CCDC141 | 0.985507 | 0.985507 | 0.985507 |
| PTPRZ1 AND DLL1 | 0.985507 | 0.985507 | 0.985507 |
| PTPRZ1 AND SLC9A9 | 0.985507 | 0.985507 | 0.985507 |
| PTPRZ1 AND CYP4V2 | 0.985507 | 0.985507 | 0.985507 |
| PTPRZ1 AND RNF180 | 0.985507 | 0.985507 | 0.985507 |
| PTPRZ1 AND DCBLD1 | 0.977778 | 1 | 0.956522 |
| PTPRZ1 AND TRIQK | 0.985507 | 0.985507 | 0.985507 |
| PTPRZ1 AND DPY19L4 | 0.970149 | 1 | 0.942029 |
| PTPRZ1 AND CRB2 | 0.985507 | 0.985507 | 0.985507 |
| PTPRZ1 AND ATP11C | 0.985294 | 1 | 0.971014 |

| Antigen Pair Logic | F1 | Precision | Recall |
|---|---|---|---|
| GREM1 AND FA2H | 0.926829 | 0.974359 | 0.883721 |
| GREM1 AND ABHD16A | 0.915663 | 0.95 | 0.883721 |
| GREM1 AND LST1 | 0.904762 | 0.926829 | 0.883721 |
| GREM1 AND TTC13 | 0.925 | 1 | 0.860465 |
| GREM1 AND RNF128 | 0.926829 | 0.974359 | 0.883721 |
| GREM1 AND RHBDF2 | 0.902439 | 0.948718 | 0.860465 |
| GREM1 AND C3orf52 | 0.925 | 1 | 0.860465 |
| GREM1 AND GALNT12 | 0.91358 | 0.973684 | 0.860465 |
| GREM1 AND TMC5 | 0.938272 | 1 | 0.883721 |
| GREM1 AND LPCAT1 | 0.911392 | 1 | 0.837209 |
| GREM1 AND DNAJC22 | 0.904762 | 0.926829 | 0.883721 |
| GREM1 AND ALPK1 | 0.926829 | 0.974359 | 0.883721 |
| GREM1 AND HSD3B7 | 0.904762 | 0.926829 | 0.883721 |
| GREM1 AND TTYH3 | 0.915663 | 0.95 | 0.883721 |
| GREM1 AND SLC44A4 | 0.926829 | 0.974359 | 0.883721 |
| GREM1 AND HM13 | 0.926829 | 0.974359 | 0.883721 |
| GREM1 AND AKAP1 | 0.926829 | 0.974359 | 0.883721 |
| GREM1 AND CRISPLD2 | 0.911392 | 1 | 0.837209 |
| GREM1 AND ARMC10 | 0.911392 | 1 | 0.837209 |
| GREM1 AND SPNS1 | 0.938272 | 1 | 0.883721 |
| GREM1 AND PLA2G10 | 0.925 | 1 | 0.860465 |
| GREM1 AND SLC41A2 | 0.9 | 0.972973 | 0.837209 |
| GREM1 AND FAR1 | 0.91358 | 0.973684 | 0.860465 |
| GREM1 AND SLC12A8 | 0.938272 | 1 | 0.883721 |
| GREM1 AND MFSD9 | 0.915663 | 0.95 | 0.883721 |
| GREM1 AND TMEM87B | 0.911392 | 1 | 0.837209 |
| GREM1 AND SLC43A1 | 0.91358 | 0.973684 | 0.860465 |
| GREM1 AND PAQR8 | 0.911392 | 1 | 0.837209 |
| GREM1 AND PPAP2C | 0.926829 | 0.974359 | 0.883721 |
| GREM1 AND DGAT1 | 0.938272 | 1 | 0.883721 |
| GREM1 AND CD164 | 0.911392 | 1 | 0.837209 |
| GREM1 AND TNFRSF14 | 0.938272 | 1 | 0.883721 |
| GREM1 AND TNFRSF10B | 0.915663 | 0.95 | 0.883721 |
| GREM1 AND GPRC5A | 0.926829 | 0.974359 | 0.883721 |
| GREM1 AND MCU | 0.911392 | 1 | 0.837209 |
| GREM1 AND SLC7A7 | 0.925 | 1 | 0.860465 |
| GREM1 AND CLDN12 | 0.938272 | 1 | 0.883721 |
| GREM1 AND SYNGR2 | 0.938272 | 1 | 0.883721 |
| GREM1 AND MARVELD3 | 0.925 | 1 | 0.860465 |
| GREM1 AND CRB3 | 0.904762 | 0.926829 | 0.883721 |
| GREM1 AND GCNT3 | 0.904762 | 0.926829 | 0.883721 |
| GREM1 AND CD7 | 0.904762 | 0.926829 | 0.883721 |
| GREM1 AND CD27 | 0.91358 | 0.973684 | 0.860465 |
| GREM1 AND PIGS | 0.915663 | 0.95 | 0.883721 |
| GREM1 AND EPSTI1 | 0.925 | 1 | 0.860465 |
| GREM1 AND CD86 | 0.904762 | 0.926829 | 0.883721 |
| GREM1 AND ENTPD6 | 0.938272 | 1 | 0.883721 |
| GREM1 AND ENTPD4 | 0.938272 | 1 | 0.883721 |
| GREM1 AND MLEC | 0.925 | 1 | 0.860465 |
| GREM1 AND ADGRE5 | 0.904762 | 0.926829 | 0.883721 |
| GREM1 AND PIEZO1 | 0.904762 | 0.926829 | 0.883721 |
| GREM1 AND EFCAB14 | 0.915663 | 0.95 | 0.883721 |
| GREM1 AND AREL1 | 0.911392 | 1 | 0.837209 |
| MUC13 AND APOLD1 | 0.911111 | 0.87234 | 0.953488 |

FIG. 6 (cont.)

| Antigen Pair Logic | F1 | Precision | Recall |
|---|---|---|---|
| PTPRZ1 AND P2RY8 | 0.985507 | 0.985507 | 0.985507 |
| PTPRZ1 AND GRIA1 | 0.985507 | 0.985507 | 0.985507 |
| GRIA2 AND SLC25A3 | 0.970149 | 1 | 0.942029 |
| PTPRZ1 AND COA3 | 0.977778 | 1 | 0.956522 |
| PTPRZ1 AND TMEM176B | 0.985507 | 0.985507 | 0.985507 |
| PTPRZ1 AND GRID2 | 0.985507 | 0.985507 | 0.985507 |
| PTPRZ1 AND SPCS1 | 0.977778 | 1 | 0.956522 |
| PTPRZ1 AND FLVCR1 | 0.985507 | 0.985507 | 0.985507 |
| PTPRZ1 AND MAGEH1 | 0.985507 | 0.985507 | 0.985507 |
| PTPRZ1 AND GRIK2 | 0.985507 | 0.985507 | 0.985507 |
| PTPRZ1 AND GRIK4 | 0.985507 | 0.985507 | 0.985507 |
| PTPRZ1 AND SLC43A3 | 0.985507 | 0.985507 | 0.985507 |
| PTPRZ1 AND GRIK5 | 0.985507 | 0.985507 | 0.985507 |
| PTPRZ1 AND GRIN2D | 0.985507 | 0.985507 | 0.985507 |
| PTPRZ1 AND C1GALT1C1 | 0.970149 | 1 | 0.942029 |
| PTPRZ1 AND GRINA | 0.985507 | 0.985507 | 0.985507 |
| PTPRZ1 AND CNIH4 | 0.985294 | 1 | 0.971014 |
| PTPRZ1 AND TMEM208 | 0.970149 | 1 | 0.942029 |
| PTPRZ1 AND DNAJC15 | 0.985507 | 0.985507 | 0.985507 |
| PTPRZ1 AND CLEC2D | 0.985507 | 0.985507 | 0.985507 |
| PTPRZ1 AND CD274 | 0.985507 | 0.985507 | 0.985507 |
| PTPRZ1 AND SLC25A5 | 0.992701 | 1 | 0.985507 |
| PTPRZ1 AND ALG5 | 0.977778 | 1 | 0.956522 |
| PTPRZ1 AND GNL2 | 0.985507 | 0.985507 | 0.985507 |
| PTPRZ1 AND GUSB | 0.970149 | 1 | 0.942029 |
| PTPRZ1 AND HILPDA | 0.985294 | 1 | 0.971014 |
| PTPRZ1 AND SEC61A1 | 0.970149 | 1 | 0.942029 |
| PTPRZ1 AND SLC40A1 | 0.977778 | 1 | 0.956522 |
| PTPRZ1 AND HEXB | 0.977778 | 1 | 0.956522 |
| PTPRZ1 AND HLA-B | 0.992701 | 1 | 0.985507 |
| PTPRZ1 AND HLA-DMA | 0.985294 | 1 | 0.971014 |
| PTPRZ1 AND HLA-DRA | 0.977778 | 1 | 0.956522 |
| PTPRZ1 AND HLA-DRB1 | 0.970149 | 1 | 0.942029 |
| PTPRZ1 AND HLA-E | 0.992701 | 1 | 0.985507 |
| PTPRZ1 AND HLA-F | 0.977778 | 1 | 0.956522 |
| PTPRZ1 AND HLA-G | 0.992701 | 1 | 0.985507 |
| APLP1 AND PTTG1IP | 0.970149 | 1 | 0.942029 |
| PTPRZ1 AND TNC | 0.970149 | 1 | 0.942029 |
| PTPRZ1 AND IFNGR2 | 0.992701 | 1 | 0.985507 |
| PTPRZ1 AND CXCR1 | 0.977778 | 1 | 0.956522 |
| PTPRZ1 AND CXCR2 | 0.992701 | 1 | 0.985507 |
| PTPRZ1 AND INPP4A | 0.992701 | 1 | 0.985507 |
| PTPRZ1 AND INSL3 | 0.992701 | 1 | 0.985507 |
| PTPRZ1 AND ITGAE | 0.985294 | 1 | 0.971014 |
| ITGAV AND GOLM1 | 0.970149 | 1 | 0.942029 |
| ITGAV AND TMEM9B | 0.970149 | 1 | 0.942029 |

(continued at top)

| Antigen Pair Logic | F1 | Precision | Recall |
|---|---|---|---|
| Adenocarcinoma\|Lung Neoplasms (Lung A) | | | |
| SFTPD AND TMEM258 | 0.944444 | 0.944444 | 0.944444 |
| Oligodendroglioma (Oligodendroglioma) | | | |
| CSPG5 AND CRTAP | 0.909091 | 0.833333 | 1 |
| CSPG5 AND TMEM115 | 0.909091 | 0.833333 | 1 |
| CSPG5 AND TSPAN11 | 0.909091 | 0.833333 | 1 |
| CSPG5 AND P2RX4 | 0.909091 | 0.833333 | 1 |
| CSPG5 AND SOAT1 | 0.909091 | 0.833333 | 1 |
| CSPG5 AND JAGN1 | 0.909091 | 0.833333 | 1 |
| CSPG5 AND GPAA1 | 0.909091 | 0.833333 | 1 |
| SORCS3 AND TMEM115 | 0.909091 | 0.833333 | 1 |
| BEST3 AND RPRM | 0.909091 | 0.833333 | 1 |
| NLGN3 AND ATP6V0E2 | 0.903226 | 0.875 | 0.933333 |
| TSPAN7 AND ZDHHC15 | 0.933333 | 0.933333 | 0.933333 |
| SORCS3 AND TSPAN11 | 0.909091 | 0.833333 | 1 |
| SORCS3 AND P2RX4 | 0.909091 | 0.833333 | 1 |
| SORCS3 AND OGFOD3 | 0.909091 | 0.833333 | 1 |
| SORCS3 AND GPAA1 | 0.909091 | 0.833333 | 1 |
| SORCS3 AND MPZL1 | 0.909091 | 0.833333 | 1 |
| GRIK3 AND FJX1 | 0.909091 | 0.833333 | 1 |
| SLC1A2 AND TBL2 | 0.909091 | 0.833333 | 1 |
| GPM6A AND DOLPP1 | 0.909091 | 0.833333 | 1 |
| GDAP1L1 AND TMEM179B | 0.909091 | 0.833333 | 1 |
| KCNJ10 AND TSPAN11 | 0.909091 | 0.833333 | 1 |
| KCNJ10 AND NAT10 | 0.909091 | 0.833333 | 1 |
| KCNJ10 AND FAM57A | 0.909091 | 0.833333 | 1 |
| KCNJ10 AND GPAA1 | 0.909091 | 0.833333 | 1 |
| SLC1A2 AND TSPAN11 | 0.909091 | 0.833333 | 1 |
| GDAP1L1 AND TSPAN11 | 0.909091 | 0.833333 | 1 |
| NLGN3 AND NDUFB1 | 0.933333 | 0.933333 | 0.933333 |
| OMG AND GPAA1 | 0.909091 | 0.833333 | 1 |
| SLC1A2 AND P2RX4 | 0.909091 | 0.833333 | 1 |
| GDAP1L1 AND P2RX4 | 0.909091 | 0.833333 | 1 |
| LINGO1 AND P2RX4 | 0.909091 | 0.833333 | 1 |
| NLGN3 AND RTN4 | 0.933333 | 0.933333 | 0.933333 |
| NLGN3 AND RPL37A | 0.933333 | 0.933333 | 0.933333 |
| SLC1A2 AND NAT10 | 0.909091 | 0.833333 | 1 |
| SLC1A2 AND DOLPP1 | 0.909091 | 0.833333 | 1 |
| GDAP1L1 AND DOLPP1 | 0.909091 | 0.833333 | 1 |
| GDAP1L1 AND MS4A6A | 0.909091 | 0.833333 | 1 |
| SLC1A2 AND MPPE1 | 0.909091 | 0.833333 | 1 |
| SLC1A2 AND SOAT1 | 0.909091 | 0.833333 | 1 |
| SLC1A2 AND JAGN1 | 0.909091 | 0.833333 | 1 |
| SLC1A2 AND GPAA1 | 0.909091 | 0.833333 | 1 |
| GDAP1L1 AND SLC22A4 | 0.909091 | 0.833333 | 1 |

FIG. 7

| Antigen Pair Logic | Cancer (short name) | F1 | Precision | Recall |
|---|---|---|---|---|
| ADAM12 AND EPCAM | Breast | 0.868687 | 0.955556 | 0.796296 |
| NOX4 AND EPCAM | Breast | 0.757282 | 0.795918 | 0.722222 |
| SLC5A6 AND EPCAM | Breast | 0.75 | 0.970588 | 0.611111 |
| EPCAM AND CALHM2 | Breast | 0.821053 | 0.95122 | 0.722222 |
| PLXND1 AND EPCAM | Breast | 0.786517 | 1 | 0.648148 |
| TGFB3 AND EPCAM | Breast | 0.741573 | 0.942857 | 0.611111 |
| PMEPA1 AND EPCAM | Breast | 0.733333 | 0.916667 | 0.611111 |
| SEMA4C AND EPCAM | Breast | 0.791209 | 0.972973 | 0.666667 |
| ADAM12 AND ERBB2 | Breast | 0.714286 | 1 | 0.555556 |
| EPCAM AND APLNR | Breast | 0.772277 | 0.829787 | 0.722222 |
| PRLR AND EPCAM | Breast | 0.707071 | 0.777778 | 0.648148 |
| EPCAM AND NTM | Breast | 0.705882 | 0.75 | 0.666667 |
| UNC5B AND EPCAM | Breast | 0.719101 | 0.914286 | 0.592593 |
| EPCAM AND CELSR2 | Breast | 0.699029 | 0.734694 | 0.666667 |
| SLC4A2 AND EPCAM | Breast | 0.698795 | 1 | 0.537037 |
| MFSD10 AND EPCAM | Breast | 0.727273 | 0.941176 | 0.592593 |
| FZD2 AND EPCAM | Breast | 0.681818 | 0.882353 | 0.555556 |
| EPCAM AND TNFSF4 | Breast | 0.828283 | 0.911111 | 0.759259 |
| F2RL2 AND EPCAM | Breast | 0.682927 | 1 | 0.518519 |
| EPCAM AND SLC1A3 | Breast | 0.792453 | 0.807692 | 0.777778 |
| EPCAM AND LRRC32 | Breast | 0.72549 | 0.770833 | 0.685185 |
| EPCAM AND FGFR1 | Breast | 0.666667 | 0.708333 | 0.62963 |
| EPCAM AND FZD7 | Breast | 0.666667 | 0.794872 | 0.574074 |
| EPCAM AND CD84 | Breast | 0.674699 | 0.965517 | 0.518519 |
| EPCAM AND SLC39A10 | Breast | 0.754717 | 0.769231 | 0.740741 |
| CXCL9 AND EPCAM | Breast | 0.817204 | 0.974359 | 0.703704 |
| EPCAM AND GJA1 | Breast | 0.75 | 0.724138 | 0.777778 |
| EPCAM AND S1PR3 | Breast | 0.660377 | 0.673077 | 0.648148 |
| EPCAM AND SLC3A2 | Breast | 0.747664 | 0.754717 | 0.740741 |
| SLC52A2 AND EPCAM | Breast | 0.659794 | 0.744186 | 0.592593 |
| EPCAM AND SLC10A3 | Breast | 0.6875 | 0.785714 | 0.611111 |
| EPCAM AND TPCN2 | Breast | 0.707965 | 0.677966 | 0.740741 |
| EPCAM AND PCDHB10 | Breast | 0.652632 | 0.756098 | 0.574074 |
| EPCAM AND APOLD1 | Breast | 0.65625 | 0.567568 | 0.777778 |
| EPCAM AND SLC9A7 | Breast | 0.651163 | 0.56 | 0.777778 |
| EPCAM AND JAG2 | Breast | 0.752475 | 0.808511 | 0.703704 |
| EPCAM AND CXCR4 | Breast | 0.649123 | 0.616667 | 0.685185 |
| EPCAM AND ITGAM | Breast | 0.848485 | 0.933333 | 0.777778 |
| EPCAM AND LPAR2 | Breast | 0.673684 | 0.780488 | 0.592593 |
| EPCAM AND ESYT1 | Breast | 0.658537 | 0.964286 | 0.5 |
| EPCAM AND STX6 | Breast | 0.772277 | 0.829787 | 0.722222 |
| EPCAM AND TSPAN5 | Breast | 0.719298 | 0.683333 | 0.759259 |
| EPCAM AND PMP22 | Breast | 0.780952 | 0.803922 | 0.759259 |
| EPCAM AND CD81 | Breast | 0.727273 | 0.714286 | 0.740741 |
| EPCAM AND ITSN1 | Breast | 0.719298 | 0.683333 | 0.759259 |
| EPCAM AND GJA5 | Breast | 0.711864 | 0.65625 | 0.777778 |
| BAMBI AND EPCAM | Breast | 0.641975 | 0.962963 | 0.481481 |
| EPCAM AND TMEM119 | Breast | 0.651163 | 0.56 | 0.777778 |
| EPCAM AND PCDHB16 | Breast | 0.650794 | 0.569444 | 0.759259 |
| EPCAM AND PTPRS | Breast | 0.666667 | 0.761905 | 0.592593 |
| EPCAM AND ADAM8 | Breast | 0.638298 | 0.75 | 0.555556 |
| EPCAM AND SLC16A6 | Breast | 0.772277 | 0.829787 | 0.722222 |
| FGG AND MSLN | Liver | 0.8 | 0.666667 | 1 |
| HPN AND TNFRSF10A | Liver | 0.666667 | 0.666667 | 0.666667 |
| ASGR1 AND MSLN | Liver | 0.75 | 0.6 | 1 |
| FGG AND TNFRSF10A | Liver | 0.666667 | 0.666667 | 0.666667 |
| GJB1 AND MSLN | Liver | 0.8 | 1 | 0.666667 |
| ABCC6 AND MSLN | Liver | 0.75 | 0.6 | 1 |
| SLC27A5 AND MSLN | Liver | 0.75 | 0.6 | 1 |
| F10 AND TNFRSF10A | Liver | 0.8 | 1 | 0.666667 |
| ABCB4 AND MSLN | Liver | 1 | 1 | 1 |
| ABCB4 AND TNFRSF10A | Liver | 0.8 | 1 | 0.666667 |
| SLC27A5 AND TNFRSF10A | Liver | 0.615385 | 0.571429 | 0.666667 |
| ABCB11 AND MSLN | Liver | 0.727273 | 0.8 | 0.666667 |
| ABCC2 AND MSLN | Liver | 1 | 1 | 1 |
| ABCC2 AND TNFRSF10A | Liver | 0.8 | 1 | 0.666667 |
| F10 AND MSLN | Liver | 1 | 1 | 1 |
| APOB AND MSLN | Liver | 0.833333 | 0.833333 | 0.833333 |
| KLB AND MSLN | Liver | 0.666667 | 0.666667 | 0.666667 |
| APOB AND TNFRSF10A | Liver | 0.6 | 0.75 | 0.5 |
| KLB AND TNFRSF10A | Liver | 0.6 | 0.75 | 0.5 |
| SLC4A2 AND MSLN | Liver | 0.666667 | 1 | 0.5 |
| ABCC6 AND MUC1 | Liver | 0.666667 | 0.555556 | 0.833333 |
| GJB1 AND MUC1 | Liver | 0.666667 | 1 | 0.5 |
| TM4SF5 AND MSLN | Liver | 0.8 | 1 | 0.666667 |
| TM4SF5 AND TNFRSF10A | Liver | 0.6 | 0.75 | 0.5 |
| F10 AND MUC1 | Liver | 0.909091 | 1 | 0.833333 |

| Antigen Pair Logic | Cancer (short name) | F1 | Precision | Recall |
|---|---|---|---|---|
| FOLH1 AND FAM57A | Prostate | 0.857143 | 1 | 0.75 |
| FOLH1 AND CDH3 | Prostate | 0.8 | 0.666667 | 1 |
| FOLH1 AND DHRS3 | Prostate | 1 | 1 | 1 |
| FOLH1 AND CD69 | Prostate | 0.888889 | 0.8 | 1 |
| FOLH1 AND CTNS | Prostate | 0.75 | 0.75 | 0.75 |
| FOLH1 AND STYK1 | Prostate | 0.888889 | 0.8 | 1 |
| DDR2 AND B4GALNT1 | Sarcoma | 0.648649 | 0.6 | 0.705882 |
| CDH11 AND EPCAM | Breast | 0.712644 | 0.939394 | 0.574074 |
| PPAPDC1A AND EPCAM | Breast | 0.711111 | 0.888889 | 0.592593 |
| EPCAM AND BST2 | Breast | 0.817204 | 0.974359 | 0.703704 |
| ENPP1 AND EPCAM | Breast | 0.672566 | 0.644068 | 0.703704 |
| EPCAM AND LAMP5 | Breast | 0.666667 | 0.794872 | 0.574074 |
| EPCAM AND SLC38A1 | Breast | 0.647619 | 0.666667 | 0.62963 |
| EPCAM AND IL17RA | Breast | 0.666667 | 0.733333 | 0.611111 |
| EPCAM AND LRRC8E | Breast | 0.712871 | 0.765957 | 0.666667 |
| EPCAM AND TGFBI | Breast | 0.672 | 0.591549 | 0.777778 |
| EPCAM AND SEMA4D | Breast | 0.638655 | 0.584615 | 0.703704 |
| EPCAM AND DYSF | Breast | 0.618557 | 0.697674 | 0.555556 |
| EPCAM AND LAPTM5 | Breast | 0.696629 | 0.885714 | 0.574074 |
| EPCAM AND TTYH2 | Breast | 0.605042 | 0.553846 | 0.666667 |
| PPAPDC1A AND ERBB2 | Breast | 0.60241 | 0.862069 | 0.462963 |
| EPCAM AND TNFRSF12A | Breast | 0.639175 | 0.72093 | 0.574074 |
| EPCAM AND GPR137B | Breast | 0.688172 | 0.820513 | 0.592593 |
| EPCAM AND VANGL1 | Breast | 0.632479 | 0.587302 | 0.685185 |
| EPCAM AND LAT | Breast | 0.672414 | 0.629032 | 0.722222 |
| EPCAM AND SLC6A6 | Breast | 0.643478 | 0.606557 | 0.685185 |
| EPCAM AND FLVCR1 | Breast | 0.650407 | 0.57971 | 0.740741 |
| EPCAM AND IFI6 | Breast | 0.638655 | 0.584615 | 0.703704 |
| EPCAM AND CD163 | Breast | 0.792453 | 0.807692 | 0.777778 |
| SLC2A2 AND MSLN | Liver | 0.857143 | 0.75 | 1 |
| SLC2A2 AND TNFRSF10A | Liver | 0.727273 | 0.8 | 0.666667 |
| SLCO1B1 AND MSLN | Liver | 0.75 | 0.6 | 1 |
| SLC17A2 AND MSLN | Liver | 0.666667 | 0.555556 | 0.833333 |
| ABCG8 AND MSLN | Liver | 0.8 | 1 | 0.666667 |
| SLC13A5 AND MSLN | Liver | 0.666667 | 0.5 | 1 |
| SLCO1B1 AND TNFRSF10A | Liver | 0.615385 | 0.571429 | 0.666667 |
| SLC17A2 AND TNFRSF10A | Liver | 0.615385 | 0.571429 | 0.666667 |
| ABCG8 AND TNFRSF10A | Liver | 0.666667 | 1 | 0.5 |
| SLC10A1 AND MSLN | Liver | 0.666667 | 0.555556 | 0.833333 |
| SLC43A1 AND TNFRSF10A | Liver | 0.8 | 1 | 0.666667 |
| ABCG5 AND MSLN | Liver | 0.75 | 0.6 | 1 |
| SLC30A8 AND CD19 | Pancreas | 0.705882 | 1 | 0.545455 |
| PPAPDC1A AND MUC1 | Pancreas | 0.666667 | 0.857143 | 0.545455 |
| KCND2 AND MUC1 | Pancreas | 0.736842 | 0.875 | 0.636364 |
| PPAPDC1A AND ERBB2 | Pancreas | 0.666667 | 0.857143 | 0.545455 |
| PPAPDC1A AND MSLN | Pancreas | 0.705882 | 1 | 0.545455 |
| CLDN10 AND MSLN | Pancreas | 0.631579 | 0.75 | 0.545455 |
| TNFRSF10B AND MUC1 | Pancreas | 0.631579 | 0.75 | 0.545455 |
| MUC1 AND SYT11 | Pancreas | 0.615385 | 0.533333 | 0.727273 |
| CD163 AND MUC1 | Pancreas | 0.666667 | 0.857143 | 0.545455 |
| MSLN AND TGFBI | Pancreas | 0.6 | 0.666667 | 0.545455 |
| IFI6 AND MUC1 | Colon | 1 | 1 | 1 |
| IFI6 AND ERBB2 | Colon | 0.909091 | 0.833333 | 1 |
| SYT11 AND ERBB2 | Glioma | 0.964539 | 0.944444 | 0.985507 |
| SYT11 AND MUC1 | Glioma | 0.94964 | 0.942857 | 0.956522 |
| SYT11 AND EPHA2 | Glioma | 0.957143 | 0.943662 | 0.971014 |
| GPR19 AND ERBB2 | Glioma | 0.816327 | 0.769231 | 0.869565 |
| LYPD1 AND MUC1 | Glioma | 0.876923 | 0.934426 | 0.826087 |
| GPR19 AND EPHA2 | Glioma | 0.802817 | 0.780822 | 0.826087 |
| GPR19 AND MUC1 | Glioma | 0.805556 | 0.773333 | 0.84058 |
| CSMD2 AND ERBB2 | Glioma | 0.691176 | 0.701493 | 0.681159 |
| BEST3 AND MUC1 | Glioma | 0.682171 | 0.733333 | 0.637681 |
| CSMD2 AND EPHA2 | Glioma | 0.666667 | 0.681818 | 0.652174 |
| SLCO1C1 AND ERBB2 | Glioma | 0.653333 | 0.604938 | 0.710145 |
| DSCAM AND ERBB2 | Glioma | 0.640777 | 0.970588 | 0.478261 |
| ASTN1 AND ERBB2 | Glioma | 0.629834 | 0.508929 | 0.826087 |
| SLCO1C1 AND MUC1 | Glioma | 0.613333 | 0.567901 | 0.666667 |
| CDH10 AND ERBB2 | Glioma | 0.604396 | 0.486726 | 0.797101 |
| FXYD6 AND ERBB2 | Glioma | 0.601156 | 0.5 | 0.753623 |
| CD163 AND ERBB2 | Glioma | 0.666667 | 0.759259 | 0.594203 |
| SLC22A16 AND CD33 | AML | 0.89505 | 0.889764 | 0.900398 |
| CD33 AND ADAM29 | AML | 0.819085 | 0.81746 | 0.820717 |
| CD33 AND SLC22A14 | AML | 0.834846 | 0.766667 | 0.916335 |
| CD33 AND SLC43A1 | AML | 0.8 | 0.945652 | 0.693227 |
| CD33 AND GJD2 | AML | 0.791252 | 0.789683 | 0.792829 |
| CD33 AND SLCO1B3 | AML | 0.812834 | 0.735484 | 0.908367 |
| CD33 AND P2RX4 | AML | 0.775862 | 0.683891 | 0.896414 |

FIG. 7 (Cont.)

| Antigen Pair Logic | Cancer (short name) | F1 | Precision | Recall |
|---|---|---|---|---|
| SDC2 AND MSLN | Liver | 0.6 | 0.75 | 0.5 |
| SLC12A7 AND MSLN | Liver | 0.833333 | 0.833333 | 0.833333 |
| KLB AND MUC1 | Liver | 0.666667 | 0.666667 | 0.666667 |
| EVA1A AND TNFRSF10A | Liver | 0.666667 | 1 | 0.5 |
| NOX4 AND MSLN | Pancreas | 0.705882 | 1 | 0.545455 |
| TNFSF4 AND MUC1 | Pancreas | 0.777778 | 1 | 0.636364 |
| MMP14 AND MUC1 | Pancreas | 0.705882 | 1 | 0.545455 |
| VSIG1 AND MSLN | Pancreas | 0.625 | 1 | 0.454545 |
| TNFSF4 AND MSLN | Pancreas | 0.631579 | 0.75 | 0.545455 |
| ADAM12 AND MUC1 | Pancreas | 0.705882 | 1 | 0.545455 |
| TNFSF13B AND MUC1 | Pancreas | 0.625 | 1 | 0.454545 |
| MMP14 AND CD19 | Pancreas | 0.7 | 0.777778 | 0.636364 |
| OSMR AND MUC1 | Pancreas | 0.777778 | 1 | 0.636364 |
| RNF144A AND MSLN | Pancreas | 0.631579 | 0.75 | 0.545455 |
| ABCC8 AND MUC1 | Pancreas | 0.705882 | 1 | 0.545455 |
| ABCC8 AND ERBB2 | Pancreas | 0.705882 | 1 | 0.545455 |
| MUC1 AND CD84 | Pancreas | 0.625 | 1 | 0.454545 |
| TNFSF4 AND ERBB2 | Pancreas | 0.636364 | 0.636364 | 0.636364 |
| SLC4A7 AND MUC1 | Pancreas | 0.705882 | 1 | 0.545455 |
| IFITM2 AND MSLN | Pancreas | 0.631579 | 0.75 | 0.545455 |
| MMP14 AND MSLN | Pancreas | 0.705882 | 1 | 0.545455 |
| TREM2 AND MUC1 | Pancreas | 0.625 | 1 | 0.454545 |
| ABCC8 AND CD19 | Pancreas | 0.705882 | 1 | 0.545455 |
| NALCN AND MUC1 | Pancreas | 0.631579 | 0.75 | 0.545455 |
| ABCC8 AND MSLN | Pancreas | 0.705882 | 1 | 0.545455 |
| FLRT2 AND ERBB2 | Pancreas | 0.631579 | 0.75 | 0.545455 |
| PTPN2 AND MUC1 | Pancreas | 0.8 | 0.888889 | 0.727273 |
| SLC2A3 AND MUC1 | Pancreas | 0.631579 | 0.75 | 0.545455 |
| SLC12A2 AND MUC1 | Colon | 0.75 | 1 | 0.6 |
| GDE1 AND MSLN | Colon | 0.75 | 1 | 0.6 |
| SPINT1 AND MSLN | Colon | 0.75 | 1 | 0.6 |
| PMEPA1 AND MSLN | Colon | 0.6 | 0.6 | 0.6 |
| PMEPA1 AND MUC1 | Colon | 0.888889 | 1 | 0.8 |
| TNFSF15 AND MUC1 | Colon | 0.6 | 0.6 | 0.6 |
| PMEPA1 AND ERBB2 | Colon | 0.666667 | 0.571429 | 0.8 |
| SLC39A10 AND MUC1 | Colon | 0.888889 | 1 | 0.8 |
| SMAGP AND MSLN | Colon | 0.75 | 1 | 0.6 |
| NRCAM AND MUC1 | Glioma | 0.909091 | 0.952381 | 0.869565 |
| NRCAM AND ERBB2 | Glioma | 0.917293 | 0.953125 | 0.884058 |
| NLGN1 AND ERBB2 | Glioma | 0.938462 | 1 | 0.884058 |
| SGCB AND MUC1 | Glioma | 0.859259 | 0.878788 | 0.84058 |
| SCN3A AND ERBB2 | Glioma | 0.789116 | 0.74359 | 0.84058 |
| SCN3A AND EPHA2 | Glioma | 0.808511 | 0.791667 | 0.826087 |
| SCN3A AND MUC1 | Glioma | 0.820896 | 0.846154 | 0.797101 |
| GRIK3 AND ERBB2 | Glioma | 0.754967 | 0.695122 | 0.826087 |
| EPHB1 AND ERBB2 | Glioma | 0.75 | 0.882353 | 0.652174 |
| FZD3 AND ERBB2 | Glioma | 0.736842 | 0.674699 | 0.811594 |
| NLGN4X AND ERBB2 | Glioma | 0.73494 | 0.628866 | 0.884058 |
| CPT1C AND ERBB2 | Glioma | 0.722892 | 0.618557 | 0.869565 |
| CPT1C AND EPHA2 | Glioma | 0.714286 | 0.606061 | 0.869565 |
| CPT1C AND MUC1 | Glioma | 0.693642 | 0.576923 | 0.869565 |
| GPR34 AND MUC1 | Glioma | 0.787402 | 0.862069 | 0.724638 |
| SLC39A10 AND ERBB2 | Glioma | 0.688889 | 0.558559 | 0.898551 |
| RAMP1 AND MUC1 | Glioma | 0.683544 | 0.606742 | 0.782609 |
| NCAM2 AND ERBB2 | Glioma | 0.675159 | 0.602273 | 0.768116 |
| CNR1 AND ERBB2 | Glioma | 0.697368 | 0.638554 | 0.768116 |
| NCAM2 AND EPHA2 | Glioma | 0.666667 | 0.588889 | 0.768116 |
| SLC39A10 AND EPHA2 | Glioma | 0.666667 | 0.552381 | 0.84058 |
| CD33 AND SLC2A5 | AML | 0.855319 | 0.917808 | 0.800797 |
| P2RX1 AND CD33 | AML | 0.839858 | 0.758842 | 0.940239 |
| MR1 AND MUC1 | Lung Adenocarcinoma | 0.60177 | 0.790698 | 0.485714 |
| CXCL9 AND CD19 | B-Cell Diffuse | 0.774194 | 0.96 | 0.648649 |
| CXCL9 AND MS4A1 | B-Cell Diffuse | 0.754098 | 0.958333 | 0.621622 |
| CXCL9 AND CD22 | B-Cell Diffuse | 0.754098 | 0.958333 | 0.621622 |
| MS4A1 AND MCOLN2 | B-Cell Diffuse | 0.709677 | 0.88 | 0.594595 |
| MS4A1 AND GJA1 | B-Cell Diffuse | 0.705882 | 0.774194 | 0.648649 |
| MS4A1 AND TNFRSF9 | B-Cell Diffuse | 0.705882 | 0.774194 | 0.648649 |
| MS4A1 AND SLCO2B1 | B-Cell Diffuse | 0.705882 | 0.774194 | 0.648649 |
| CD19 AND SLC2A5 | B-Cell Diffuse | 0.698413 | 0.846154 | 0.594595 |
| MS4A1 AND SLC1A3 | B-Cell Diffuse | 0.69697 | 0.793103 | 0.621622 |
| MS4A1 AND PPAP2B | B-Cell Diffuse | 0.695652 | 0.75 | 0.648649 |
| MS4A1 AND AQP7 | B-Cell Diffuse | 0.69697 | 0.793103 | 0.621622 |
| CXCL10 AND CD22 | B-Cell Diffuse | 0.6875 | 0.814815 | 0.594595 |
| MS4A1 AND PDGFRA | B-Cell Diffuse | 0.686567 | 0.766667 | 0.621622 |
| MS4A1 AND DDR2 | B-Cell Diffuse | 0.686567 | 0.766667 | 0.621622 |
| MS4A1 AND ANTXR1 | B-Cell Diffuse | 0.686567 | 0.766667 | 0.621622 |
| MS4A1 AND OSMR | B-Cell Diffuse | 0.686567 | 0.766667 | 0.621622 |

| Antigen Pair Logic | Cancer (short name) | F1 | Precision | Recall |
|---|---|---|---|---|
| CD33 AND KCND2 | AML | 0.720764 | 0.89881 | 0.601594 |
| CD33 AND OTOF | AML | 0.715294 | 0.873563 | 0.605578 |
| CD33 AND SLC39A8 | AML | 0.710145 | 0.90184 | 0.585657 |
| CD33 AND CSPG5 | AML | 0.709251 | 0.793103 | 0.641434 |
| MLC1 AND CD33 | AML | 0.700405 | 0.711934 | 0.689243 |
| CD33 AND SLC5A10 | AML | 0.693446 | 0.738739 | 0.653386 |
| CD33 AND STAB1 | AML | 0.67803 | 0.646209 | 0.713147 |
| CD33 AND KCNJ9 | AML | 0.664962 | 0.928571 | 0.517928 |
| SLC22A16 AND IL3RA | AML | 0.610966 | 0.886364 | 0.466135 |
| CD33 AND SLC2A1 | AML | 0.608696 | 0.85 | 0.474104 |
| CD33 AND SPAM1 | AML | 0.604396 | 0.973451 | 0.438247 |
| MS4A1 AND KCNJ10 | B-Cell Diffuse | 0.69697 | 0.793103 | 0.621622 |
| MS4A1 AND CDH11 | B-Cell Diffuse | 0.686567 | 0.766667 | 0.621622 |
| CD19 AND KCNJ10 | B-Cell Diffuse | 0.656716 | 0.733333 | 0.594595 |
| MS4A1 AND EFNB2 | B-Cell Diffuse | 0.656716 | 0.733333 | 0.594595 |
| MS4A1 AND FAT1 | B-Cell Diffuse | 0.647059 | 0.709677 | 0.594595 |
| MS4A1 AND PLVAP | B-Cell Diffuse | 0.65625 | 0.777778 | 0.567568 |
| CD19 AND CSPG5 | B-Cell Diffuse | 0.628571 | 0.666667 | 0.594595 |
| CD19 AND CDH11 | B-Cell Diffuse | 0.628571 | 0.666667 | 0.594595 |
| MS4A1 AND AOC3 | B-Cell Diffuse | 0.626866 | 0.7 | 0.567568 |
| MS4A1 AND PROCR | B-Cell Diffuse | 0.606061 | 0.689655 | 0.540541 |
| CD19 AND ADCY10 | Mantle-Cell Lymphoma | 0.914286 | 1 | 0.842105 |
| CD19 AND JPH3 | Mantle-Cell Lymphoma | 0.914286 | 1 | 0.842105 |
| CD19 AND SLC22A18 | Mantle-Cell Lymphoma | 0.914286 | 1 | 0.842105 |
| CD19 AND SCN8A | Mantle-Cell Lymphoma | 0.914286 | 1 | 0.842105 |
| CD19 AND HCN2 | Mantle-Cell Lymphoma | 0.914286 | 1 | 0.842105 |
| CD19 AND PCDHAC2 | Mantle-Cell Lymphoma | 0.914286 | 1 | 0.842105 |
| CD19 AND KCNA1 | Mantle-Cell Lymphoma | 0.914286 | 1 | 0.842105 |
| CD19 AND SLC22A16 | Mantle-Cell Lymphoma | 0.914286 | 1 | 0.842105 |
| CD19 AND MC2R | Mantle-Cell Lymphoma | 0.914286 | 1 | 0.842105 |
| CD19 AND LCT | Mantle-Cell Lymphoma | 0.914286 | 1 | 0.842105 |
| CD19 AND CLDN17 | Mantle-Cell Lymphoma | 0.914286 | 1 | 0.842105 |
| CD19 AND DCC | Mantle-Cell Lymphoma | 0.914286 | 1 | 0.842105 |
| CD19 AND CLDN20 | Mantle-Cell Lymphoma | 0.914286 | 1 | 0.842105 |
| CD19 AND CATSPERD | Mantle-Cell Lymphoma | 0.914286 | 1 | 0.842105 |
| CD19 AND PTGIR | Mantle-Cell Lymphoma | 0.914286 | 1 | 0.842105 |
| CD19 AND ADAM20 | Mantle-Cell Lymphoma | 0.914286 | 1 | 0.842105 |
| CD19 AND CNTNAP4 | Mantle-Cell Lymphoma | 0.914286 | 1 | 0.842105 |
| CD19 AND MPL | Mantle-Cell Lymphoma | 0.914286 | 1 | 0.842105 |
| CD19 AND MRGPRX2 | Mantle-Cell Lymphoma | 0.914286 | 1 | 0.842105 |
| CD19 AND GHSR | Mantle-Cell Lymphoma | 0.914286 | 1 | 0.842105 |
| CD19 AND KCNC1 | Mantle-Cell Lymphoma | 0.914286 | 1 | 0.842105 |
| CD19 AND CCKBR | Mantle-Cell Lymphoma | 0.914286 | 1 | 0.842105 |
| CD19 AND TMEM235 | Mantle-Cell Lymphoma | 0.914286 | 1 | 0.842105 |
| CD19 AND HTR3C | Mantle-Cell Lymphoma | 0.914286 | 1 | 0.842105 |
| CD19 AND PRND | Mantle-Cell Lymphoma | 0.914286 | 1 | 0.842105 |
| CD19 AND NTSR2 | Mantle-Cell Lymphoma | 0.914286 | 1 | 0.842105 |
| CD19 AND TAS1R1 | Mantle-Cell Lymphoma | 0.914286 | 1 | 0.842105 |
| CD19 AND GPR156 | Mantle-Cell Lymphoma | 0.914286 | 1 | 0.842105 |
| CD19 AND SLC30A8 | Mantle-Cell Lymphoma | 0.914286 | 1 | 0.842105 |
| CD19 AND GNRHR | Mantle-Cell Lymphoma | 0.914286 | 1 | 0.842105 |
| CD19 AND DTNA | Mantle-Cell Lymphoma | 0.914286 | 1 | 0.842105 |
| CD19 AND CDH22 | Mantle-Cell Lymphoma | 0.914286 | 1 | 0.842105 |
| CD19 AND OR3A2 | Mantle-Cell Lymphoma | 0.914286 | 1 | 0.842105 |
| CD19 AND CACNG1 | Mantle-Cell Lymphoma | 0.914286 | 1 | 0.842105 |
| CD19 AND SLC22A12 | Mantle-Cell Lymphoma | 0.914286 | 1 | 0.842105 |
| CD19 AND OR52D1 | Mantle-Cell Lymphoma | 0.914286 | 1 | 0.842105 |
| CD19 AND OR7C1 | Mantle-Cell Lymphoma | 0.914286 | 1 | 0.842105 |
| CD19 AND GPR50 | Mantle-Cell Lymphoma | 0.914286 | 1 | 0.842105 |
| CD19 AND FGF6 | Mantle-Cell Lymphoma | 0.914286 | 1 | 0.842105 |
| CD19 AND GPR158 | Mantle-Cell Lymphoma | 0.914286 | 1 | 0.842105 |
| CD19 AND DRD5 | Mantle-Cell Lymphoma | 0.914286 | 1 | 0.842105 |
| CD19 AND OR10J1 | Mantle-Cell Lymphoma | 0.914286 | 1 | 0.842105 |
| CD19 AND USH2A | Mantle-Cell Lymphoma | 0.914286 | 1 | 0.842105 |
| CD19 AND MUC17 | Mantle-Cell Lymphoma | 0.914286 | 1 | 0.842105 |
| CD19 AND KCNV2 | Mantle-Cell Lymphoma | 0.898551 | 1 | 0.815789 |
| CD19 AND EPHA10 | Mantle-Cell Lymphoma | 0.898551 | 1 | 0.815789 |
| CD19 AND CALN1 | Mantle-Cell Lymphoma | 0.898551 | 1 | 0.815789 |
| CD19 AND SLC4A5 | Mantle-Cell Lymphoma | 0.898551 | 1 | 0.815789 |
| CD19 AND CLDN15 | Mantle-Cell Lymphoma | 0.898551 | 1 | 0.815789 |
| CD19 AND TRPC7 | Mantle-Cell Lymphoma | 0.898551 | 1 | 0.815789 |
| CD19 AND CDH18 | Mantle-Cell Lymphoma | 0.898551 | 1 | 0.815789 |
| CD19 AND CRB1 | Mantle-Cell Lymphoma | 0.898551 | 1 | 0.815789 |
| CD19 AND HTR6 | Mantle-Cell Lymphoma | 0.898551 | 1 | 0.815789 |
| CD19 AND CACNG2 | Mantle-Cell Lymphoma | 0.898551 | 1 | 0.815789 |
| CD19 AND STAB1 | Mantle-Cell Lymphoma | 0.898551 | 1 | 0.815789 |
| CD19 AND SLC22A2 | Mantle-Cell Lymphoma | 0.898551 | 1 | 0.815789 |

FIG. 7 (Cont.)

| Antigen Pair Logic | Cancer (short name) | F1 | Precision | Recall |
|---|---|---|---|---|
| MS4A1 AND TMEM119 | B-Cell Diffuse | 0.686567 | 0.766667 | 0.621622 |
| MS4A1 AND CDH5 | B-Cell Diffuse | 0.686567 | 0.766667 | 0.621622 |
| MCOLN2 AND CD22 | B-Cell Diffuse | 0.760563 | 0.794118 | 0.72973 |
| MS4A1 AND SLC2A5 | B-Cell Diffuse | 0.685714 | 0.727273 | 0.648649 |
| CD80 AND CD22 | B-Cell Diffuse | 0.712329 | 0.722222 | 0.702703 |
| CD19 AND MCOLN2 | B-Cell Diffuse | 0.677419 | 0.84 | 0.567568 |
| CD19 AND BRCA1 | B-Cell Diffuse | 0.676923 | 0.785714 | 0.594595 |
| MS4A1 AND KCNMA1 | B-Cell Diffuse | 0.676471 | 0.741935 | 0.621622 |
| MS4A1 AND GJA4 | B-Cell Diffuse | 0.676923 | 0.785714 | 0.594595 |
| MS4A1 AND MCAM | B-Cell Diffuse | 0.666667 | 0.71875 | 0.621622 |
| CD19 AND ATP2A1 | B-Cell Diffuse | 0.666667 | 0.758621 | 0.594595 |
| MS4A1 AND UNC5B | B-Cell Diffuse | 0.666667 | 0.71875 | 0.621622 |
| CD22 AND SLC2A5 | B-Cell Diffuse | 0.698795 | 0.630435 | 0.783784 |
| MS4A1 AND TM4SF1 | B-Cell Diffuse | 0.666667 | 0.758621 | 0.594595 |
| MS4A1 AND TSPAN7 | B-Cell Diffuse | 0.666667 | 0.758621 | 0.594595 |
| MS4A1 AND CSF1 | B-Cell Diffuse | 0.666667 | 0.758621 | 0.594595 |
| MS4A1 AND TMEM47 | B-Cell Diffuse | 0.666667 | 0.758621 | 0.594595 |
| MS4A1 AND AQP1 | B-Cell Diffuse | 0.666667 | 0.758621 | 0.594595 |
| MS4A1 AND PMP22 | B-Cell Diffuse | 0.657534 | 0.666667 | 0.648649 |
| MS4A1 AND ENPP2 | B-Cell Diffuse | 0.657534 | 0.666667 | 0.648649 |
| MS4A1 AND SDC2 | B-Cell Diffuse | 0.657143 | 0.69697 | 0.621622 |
| MS4A1 AND CAV1 | B-Cell Diffuse | 0.657143 | 0.69697 | 0.621622 |
| MS4A1 AND FZD4 | B-Cell Diffuse | 0.666667 | 0.758621 | 0.594595 |
| MS4A1 AND ECSCR | B-Cell Diffuse | 0.647887 | 0.676471 | 0.621622 |
| MS4A1 AND SLC25A4 | B-Cell Diffuse | 0.647059 | 0.709677 | 0.594595 |
| CD19 AND TNFRSF9 | B-Cell Diffuse | 0.647059 | 0.709677 | 0.594595 |
| MS4A1 AND CMKLR1 | B-Cell Diffuse | 0.647059 | 0.709677 | 0.594595 |
| MS4A1 AND CD80 | B-Cell Diffuse | 0.646154 | 0.75 | 0.567568 |
| CD19 AND SLC1A3 | B-Cell Diffuse | 0.646154 | 0.75 | 0.567568 |
| CD19 AND NDRG4 | Mantle-Cell Lymphoma | 0.914286 | 1 | 0.842105 |
| CD19 AND DPP4 | Mantle-Cell Lymphoma | 0.914286 | 1 | 0.842105 |
| CD19 AND SLC13A3 | Mantle-Cell Lymphoma | 0.914286 | 1 | 0.842105 |
| CD19 AND P2RY2 | Mantle-Cell Lymphoma | 0.914286 | 1 | 0.842105 |
| CD19 AND KCNH5 | Mantle-Cell Lymphoma | 0.914286 | 1 | 0.842105 |
| CD19 AND LPAR3 | Mantle-Cell Lymphoma | 0.914286 | 1 | 0.842105 |
| CD19 AND SLC7A2 | Mantle-Cell Lymphoma | 0.914286 | 1 | 0.842105 |
| CD19 AND MARVELD2 | Mantle-Cell Lymphoma | 0.914286 | 1 | 0.842105 |
| CD19 AND LY6D | Mantle-Cell Lymphoma | 0.914286 | 1 | 0.842105 |
| CD19 AND NOX4 | Mantle-Cell Lymphoma | 0.914286 | 1 | 0.842105 |
| CD19 AND TRHDE | Mantle-Cell Lymphoma | 0.914286 | 1 | 0.842105 |
| CD19 AND MRGPRX4 | Mantle-Cell Lymphoma | 0.914286 | 1 | 0.842105 |
| CD19 AND STRA6 | Mantle-Cell Lymphoma | 0.914286 | 1 | 0.842105 |
| CD19 AND APOB | Mantle-Cell Lymphoma | 0.914286 | 1 | 0.842105 |
| CD19 AND PCDHB11 | Mantle-Cell Lymphoma | 0.914286 | 1 | 0.842105 |
| CD19 AND GDE1 | Mantle-Cell Lymphoma | 0.914286 | 1 | 0.842105 |
| CD19 AND PDE6B | Mantle-Cell Lymphoma | 0.914286 | 1 | 0.842105 |
| CD19 AND CLECL1 | Mantle-Cell Lymphoma | 0.914286 | 1 | 0.842105 |
| CD19 AND LRRC32 | Mantle-Cell Lymphoma | 0.914286 | 1 | 0.842105 |
| CD19 AND TMEM30B | Mantle-Cell Lymphoma | 0.914286 | 1 | 0.842105 |
| CD19 AND ITGA2 | Mantle-Cell Lymphoma | 0.914286 | 1 | 0.842105 |
| CD19 AND RHBDL1 | Mantle-Cell Lymphoma | 0.914286 | 1 | 0.842105 |
| CD19 AND IL5RA | Mantle-Cell Lymphoma | 0.914286 | 1 | 0.842105 |
| CD19 AND DCHS2 | Mantle-Cell Lymphoma | 0.914286 | 1 | 0.842105 |
| CD19 AND ADAM22 | Mantle-Cell Lymphoma | 0.914286 | 1 | 0.842105 |
| CD19 AND CORIN | Mantle-Cell Lymphoma | 0.914286 | 1 | 0.842105 |
| CD19 AND TMEM150B | Mantle-Cell Lymphoma | 0.914286 | 1 | 0.842105 |
| CD19 AND KNCN | Mantle-Cell Lymphoma | 0.914286 | 1 | 0.842105 |
| CD19 AND TAS2R39 | Mantle-Cell Lymphoma | 0.914286 | 1 | 0.842105 |
| CD19 AND ANO1 | Mantle-Cell Lymphoma | 0.914286 | 1 | 0.842105 |
| CD19 AND CXADR | Mantle-Cell Lymphoma | 0.914286 | 1 | 0.842105 |
| CD19 AND CCR8 | Mantle-Cell Lymphoma | 0.914286 | 1 | 0.842105 |
| CD19 AND CHRM3 | Mantle-Cell Lymphoma | 0.914286 | 1 | 0.842105 |
| CD19 AND FRAS1 | Mantle-Cell Lymphoma | 0.914286 | 1 | 0.842105 |
| CD19 AND EVA1A | Mantle-Cell Lymphoma | 0.914286 | 1 | 0.842105 |
| CD19 AND CDH19 | Mantle-Cell Lymphoma | 0.914286 | 1 | 0.842105 |
| CD19 AND NPBWR2 | Mantle-Cell Lymphoma | 0.914286 | 1 | 0.842105 |
| CD19 AND OR1G1 | Mantle-Cell Lymphoma | 0.914286 | 1 | 0.842105 |
| CD19 AND PROKR2 | Mantle-Cell Lymphoma | 0.914286 | 1 | 0.842105 |
| CD19 AND SLC24A4 | Mantle-Cell Lymphoma | 0.914286 | 1 | 0.842105 |
| CD19 AND OR51B5 | Mantle-Cell Lymphoma | 0.914286 | 1 | 0.842105 |
| CD19 AND FCRL4 | Mantle-Cell Lymphoma | 0.914286 | 1 | 0.842105 |
| CD19 AND PCDHB12 | Mantle-Cell Lymphoma | 0.914286 | 1 | 0.842105 |
| CD19 AND VN1R1 | Mantle-Cell Lymphoma | 0.914286 | 1 | 0.842105 |
| CD19 AND SLC24A3 | Mantle-Cell Lymphoma | 0.914286 | 1 | 0.842105 |
| CD19 AND ADORA2B | Mantle-Cell Lymphoma | 0.914286 | 1 | 0.842105 |
| CD19 AND OXGR1 | Mantle-Cell Lymphoma | 0.914286 | 1 | 0.842105 |
| CD19 AND AOC2 | Mantle-Cell Lymphoma | 0.914286 | 1 | 0.842105 |
| CD19 AND SLC39A2 | Mantle-Cell Lymphoma | 0.898551 | 1 | 0.815789 |
| CD19 AND CEACAM7 | Mantle-Cell Lymphoma | 0.898551 | 1 | 0.815789 |
| CD19 AND TSHR | Mantle-Cell Lymphoma | 0.898551 | 1 | 0.815789 |
| CD19 AND SLC22A11 | Mantle-Cell Lymphoma | 0.898551 | 1 | 0.815789 |
| CD19 AND PCDHGC4 | Mantle-Cell Lymphoma | 0.898551 | 1 | 0.815789 |
| CD19 AND GRIN2B | Mantle-Cell Lymphoma | 0.898551 | 1 | 0.815789 |
| CD19 AND TRPM3 | Mantle-Cell Lymphoma | 0.898551 | 1 | 0.815789 |
| CD19 AND ADAM7 | Mantle-Cell Lymphoma | 0.898551 | 1 | 0.815789 |
| CD19 AND MRAP | Mantle-Cell Lymphoma | 0.898551 | 1 | 0.815789 |
| CD19 AND GRIN1 | Mantle-Cell Lymphoma | 0.898551 | 1 | 0.815789 |
| CD19 AND GABRB2 | Mantle-Cell Lymphoma | 0.898551 | 1 | 0.815789 |
| CD19 AND SLC17A1 | Mantle-Cell Lymphoma | 0.914286 | 1 | 0.842105 |
| CD19 AND PPAPDC1A | Mantle-Cell Lymphoma | 0.914286 | 1 | 0.842105 |
| CD19 AND KCNJ9 | Mantle-Cell Lymphoma | 0.914286 | 1 | 0.842105 |
| CD19 AND CNGA4 | Mantle-Cell Lymphoma | 0.914286 | 1 | 0.842105 |
| CD19 AND OPALIN | Mantle-Cell Lymphoma | 0.914286 | 1 | 0.842105 |
| CD19 AND GRM6 | Mantle-Cell Lymphoma | 0.914286 | 1 | 0.842105 |
| CD19 AND P2RX3 | Mantle-Cell Lymphoma | 0.914286 | 1 | 0.842105 |
| CD19 AND BEST2 | Mantle-Cell Lymphoma | 0.914286 | 1 | 0.842105 |
| CD19 AND DISP2 | Mantle-Cell Lymphoma | 0.914286 | 1 | 0.842105 |
| CD19 AND ZACN | Mantle-Cell Lymphoma | 0.914286 | 1 | 0.842105 |
| CD19 AND GPR12 | Mantle-Cell Lymphoma | 0.914286 | 1 | 0.842105 |
| CD19 AND CABP7 | Mantle-Cell Lymphoma | 0.914286 | 1 | 0.842105 |
| CD19 AND SLC17A3 | Mantle-Cell Lymphoma | 0.898551 | 1 | 0.815789 |
| CD19 AND CRB2 | Mantle-Cell Lymphoma | 0.914286 | 1 | 0.842105 |
| CD19 AND AJAP1 | Mantle-Cell Lymphoma | 0.914286 | 1 | 0.842105 |
| CD19 AND ZP4 | Mantle-Cell Lymphoma | 0.914286 | 1 | 0.842105 |
| CD19 AND ORSP3 | Mantle-Cell Lymphoma | 0.914286 | 1 | 0.842105 |
| CD19 AND KCNK10 | Mantle-Cell Lymphoma | 0.914286 | 1 | 0.842105 |
| CD19 AND EPHA8 | Mantle-Cell Lymphoma | 0.914286 | 1 | 0.842105 |
| CD19 AND HCN1 | Mantle-Cell Lymphoma | 0.914286 | 1 | 0.842105 |
| CD19 AND ATP6V0A4 | Mantle-Cell Lymphoma | 0.914286 | 1 | 0.842105 |
| CD19 AND SLC1A6 | Mantle-Cell Lymphoma | 0.914286 | 1 | 0.842105 |
| CD19 AND CHRNA1 | Mantle-Cell Lymphoma | 0.914286 | 1 | 0.842105 |
| CD19 AND SLC22A14 | Mantle-Cell Lymphoma | 0.914286 | 1 | 0.842105 |
| MLANA AND GPR137B | Melanoma | 1 | 1 | 1 |
| GPR19 AND B4GALNT1 | Neuroblastoma | 0.624 | 0.46988 | 0.928571 |
| FLVCR1 AND B4GALNT1 | Neuroblastoma | 0.643836 | 0.758065 | 0.559524 |
| B4GALNT1 AND ATP7A | Neuroblastoma | 0.675159 | 0.726027 | 0.630952 |
| FOLH1 AND STEAP4 | Prostate | 0.857143 | 1 | 0.75 |
| FOLH1 AND ANTXR2 | Prostate | 0.727273 | 0.571429 | 1 |
| FOLH1 AND PTGIS | Prostate | 0.8 | 0.666667 | 1 |
| FOLH1 AND SLC43A1 | Prostate | 1 | 1 | 1 |
| FOLH1 AND GGTLC1 | Prostate | 1 | 1 | 1 |
| UPK3A AND FOLH1 | Prostate | 0.666667 | 0.6 | 0.75 |
| FOLH1 AND GHR | Prostate | 0.857143 | 1 | 0.75 |
| FOLH1 AND ATP7A | Prostate | 0.888889 | 0.8 | 1 |
| FOLH1 AND GUCY2D | Prostate | 0.666667 | 0.6 | 0.75 |
| FOLH1 AND ATP8B2 | Prostate | 0.666667 | 0.5 | 1 |
| FOLH1 AND FAT1 | Prostate | 0.857143 | 1 | 0.75 |
| FOLH1 AND GABRG3 | Prostate | 0.666667 | 0.6 | 0.75 |
| FOLH1 AND ATP8B1 | Prostate | 0.615385 | 0.444444 | 1 |
| FOLH1 AND EMP3 | Prostate | 0.727273 | 0.571429 | 1 |
| FOLH1 AND FLVCR1 | Prostate | 0.727273 | 0.571429 | 1 |
| FOLH1 AND VANGL1 | Prostate | 0.727273 | 0.571429 | 1 |
| FOLH1 AND MRGPRF | Prostate | 0.6 | 0.5 | 0.75 |
| FOLH1 AND SEMA4B | Prostate | 0.727273 | 0.571429 | 1 |
| FOLH1 AND PPAPDC1B | Prostate | 0.615385 | 0.444444 | 1 |
| FOLH1 AND CD93 | Prostate | 0.857143 | 1 | 0.75 |
| FOLH1 AND SLC1A5 | Prostate | 0.615385 | 0.444444 | 1 |
| FOLH1 AND PAQR7 | Prostate | 0.857143 | 1 | 0.75 |
| FOLH1 AND ENPP1 | Prostate | 0.857143 | 1 | 0.75 |
| FOLH1 AND SLC22A5 | Prostate | 0.857143 | 1 | 0.75 |
| FOLH1 AND ZACN | Prostate | 0.666667 | 1 | 0.5 |
| FOLH1 AND TTYH3 | Prostate | 0.666667 | 1 | 0.5 |
| FOLH1 AND CD44 | Prostate | 0.615385 | 0.444444 | 1 |
| FOLH1 AND MPL | Prostate | 0.8 | 0.666667 | 1 |
| FOLH1 AND CD163 | Prostate | 1 | 1 | 1 |
| FOLH1 AND F2R | Prostate | 0.888889 | 0.8 | 1 |
| FOLH1 AND AOC3 | Prostate | 0.727273 | 0.571429 | 1 |
| FOLH1 AND PHLDB2 | Prostate | 0.615385 | 0.444444 | 1 |
| FOLH1 AND ANPEP | Prostate | 0.727273 | 0.571429 | 1 |
| FOLH1 AND DGKE | Prostate | 0.857143 | 1 | 0.75 |
| FOLH1 AND KCNK6 | Prostate | 0.615385 | 0.444444 | 1 |
| FOLH1 AND BTN3A1 | Prostate | 0.8 | 0.666667 | 1 |
| FOLH1 AND PTGER4 | Prostate | 0.857143 | 1 | 0.75 |
| FAP AND EPCAM | Breast | 0.875 | 1 | 0.777778 |

FIG. 7 (Cont.)

| Antigen Pair Logic | Cancer (short name) | F1 | Precision | Recall |
|---|---|---|---|---|
| CD19 AND PCDH10 | Mantle-Cell Lymphoma | 0.914286 | 1 | 0.842105 |
| CD19 AND SLC26A7 | Mantle-Cell Lymphoma | 0.914286 | 1 | 0.842105 |
| CD19 AND HTR1B | Mantle-Cell Lymphoma | 0.914286 | 1 | 0.842105 |
| CD19 AND OR51E1 | Mantle-Cell Lymphoma | 0.914286 | 1 | 0.842105 |
| CD19 AND HTR2A | Mantle-Cell Lymphoma | 0.914286 | 1 | 0.842105 |
| CD19 AND IL1RL1 | Mantle-Cell Lymphoma | 0.914286 | 1 | 0.842105 |
| CD19 AND OR7A5 | Mantle-Cell Lymphoma | 0.914286 | 1 | 0.842105 |
| CD19 AND CHRM5 | Mantle-Cell Lymphoma | 0.914286 | 1 | 0.842105 |
| CD19 AND PKHD1 | Mantle-Cell Lymphoma | 0.914286 | 1 | 0.842105 |
| CD19 AND AQP4 | Mantle-Cell Lymphoma | 0.914286 | 1 | 0.842105 |
| CD19 AND EPHB1 | Mantle-Cell Lymphoma | 0.914286 | 1 | 0.842105 |
| CD19 AND EFNB3 | Mantle-Cell Lymphoma | 0.914286 | 1 | 0.842105 |
| CD19 AND TIE1 | Mantle-Cell Lymphoma | 0.914286 | 1 | 0.842105 |
| CD19 AND SI | Mantle-Cell Lymphoma | 0.914286 | 1 | 0.842105 |
| CD19 AND KCNK1 | Mantle-Cell Lymphoma | 0.914286 | 1 | 0.842105 |
| CD19 AND AGTR1 | Mantle-Cell Lymphoma | 0.914286 | 1 | 0.842105 |
| CD19 AND P2RX2 | Mantle-Cell Lymphoma | 0.914286 | 1 | 0.842105 |
| CD19 AND OR51M1 | Mantle-Cell Lymphoma | 0.914286 | 1 | 0.842105 |
| CD19 AND UPK1B | Mantle-Cell Lymphoma | 0.914286 | 1 | 0.842105 |
| CD19 AND SFRP1 | Mantle-Cell Lymphoma | 0.914286 | 1 | 0.842105 |
| CD19 AND SLC5A9 | Mantle-Cell Lymphoma | 0.914286 | 1 | 0.842105 |
| CD19 AND ATP4A | Mantle-Cell Lymphoma | 0.914286 | 1 | 0.842105 |
| CD19 AND ABCC8 | Mantle-Cell Lymphoma | 0.914286 | 1 | 0.842105 |
| CD19 AND MAS1 | Mantle-Cell Lymphoma | 0.914286 | 1 | 0.842105 |
| CD19 AND CDH6 | Mantle-Cell Lymphoma | 0.914286 | 1 | 0.842105 |
| CD19 AND KCNG3 | Mantle-Cell Lymphoma | 0.914286 | 1 | 0.842105 |
| CD19 AND EMCN | Mantle-Cell Lymphoma | 0.914286 | 1 | 0.842105 |
| CD19 AND LRP4 | Mantle-Cell Lymphoma | 0.914286 | 1 | 0.842105 |
| CD19 AND OPN5 | Mantle-Cell Lymphoma | 0.914286 | 1 | 0.842105 |
| CD19 AND KIR2DL4 | Mantle-Cell Lymphoma | 0.914286 | 1 | 0.842105 |
| CD19 AND KCNE1 | Mantle-Cell Lymphoma | 0.914286 | 1 | 0.842105 |
| CD19 AND EDNRA | Mantle-Cell Lymphoma | 0.914286 | 1 | 0.842105 |
| CD19 AND TSPAN1 | Mantle-Cell Lymphoma | 0.914286 | 1 | 0.842105 |
| CD19 AND SLC8A1 | Mantle-Cell Lymphoma | 0.914286 | 1 | 0.842105 |
| CD19 AND EPHA1 | Mantle-Cell Lymphoma | 0.914286 | 1 | 0.842105 |
| CD19 AND FLRT3 | Mantle-Cell Lymphoma | 0.914286 | 1 | 0.842105 |
| CD19 AND ERVFRD-1 | Mantle-Cell Lymphoma | 0.914286 | 1 | 0.842105 |
| CD19 AND KIR2DL3 | Mantle-Cell Lymphoma | 0.914286 | 1 | 0.842105 |
| CD19 AND SLC16A1 | Mantle-Cell Lymphoma | 0.914286 | 1 | 0.842105 |
| CD19 AND NOX3 | Mantle-Cell Lymphoma | 0.914286 | 1 | 0.842105 |
| CD19 AND SLC26A10 | Mantle-Cell Lymphoma | 0.914286 | 1 | 0.842105 |
| CD19 AND OR1J4 | Mantle-Cell Lymphoma | 0.914286 | 1 | 0.842105 |
| CD19 AND SLC12A4 | Mantle-Cell Lymphoma | 0.914286 | 1 | 0.842105 |
| CD19 AND MFSD2A | Mantle-Cell Lymphoma | 0.914286 | 1 | 0.842105 |
| MLANA AND KCNK15 | Melanoma | 1 | 1 | 1 |
| MLANA AND SLC20A1 | Melanoma | 0.952381 | 1 | 0.909091 |
| SLC6A2 AND B4GALNT1 | Neuroblastoma | 0.810127 | 0.864865 | 0.761905 |
| SCN9A AND B4GALNT1 | Neuroblastoma | 0.766467 | 0.771084 | 0.761905 |
| THSD7A AND B4GALNT1 | Neuroblastoma | 0.695187 | 0.631068 | 0.77381 |
| SLC29A4 AND B4GALNT1 | Neuroblastoma | 0.69281 | 0.768116 | 0.630952 |
| TUSC3 AND B4GALNT1 | Neuroblastoma | 0.69281 | 0.768116 | 0.630952 |
| XPR1 AND B4GALNT1 | Neuroblastoma | 0.6625 | 0.697368 | 0.630952 |
| CADM1 AND B4GALNT1 | Neuroblastoma | 0.641791 | 0.86 | 0.511905 |
| HTRA2 AND B4GALNT1 | Neuroblastoma | 0.626866 | 0.84 | 0.5 |
| SLC26A11 AND B4GALNT1 | Neuroblastoma | 0.609375 | 0.886364 | 0.464286 |
| B4GALNT1 AND PEMT | Neuroblastoma | 0.666667 | 0.824561 | 0.559524 |
| B4GALNT1 AND YIPF3 | Neuroblastoma | 0.657895 | 0.735294 | 0.595238 |
| B4GALNT1 AND SLC38A2 | Neuroblastoma | 0.679739 | 0.753623 | 0.619048 |
| LDLRAD3 AND B4GALNT1 | Neuroblastoma | 0.630872 | 0.723077 | 0.559524 |
| B4GALNT1 AND VIMP | Neuroblastoma | 0.601504 | 0.816327 | 0.47619 |
| B4GALNT1 AND JTB | Neuroblastoma | 0.607595 | 0.648649 | 0.571429 |
| DCHS1 AND B4GALNT1 | Neuroblastoma | 0.714286 | 0.892857 | 0.595238 |
| FOLH1 AND CACNA1D | Prostate | 0.857143 | 1 | 0.75 |
| FOLH1 AND BCAM | Prostate | 0.727273 | 0.571429 | 1 |
| OR51E1 AND FOLH1 | Prostate | 0.857143 | 1 | 0.75 |
| FOLH1 AND ADRB2 | Prostate | 1 | 1 | 1 |
| TSPAN1 AND FOLH1 | Prostate | 0.666667 | 1 | 0.5 |
| FOLH1 AND PCDHB14 | Prostate | 0.75 | 0.75 | 0.75 |
| FOLH1 AND VIPR1 | Prostate | 0.857143 | 1 | 0.75 |
| FOLH1 AND SERINC5 | Prostate | 0.666667 | 1 | 0.5 |
| FOLH1 AND GOLM1 | Prostate | 1 | 1 | 1 |
| FOLH1 AND EDNRA | Prostate | 0.727273 | 0.571429 | 1 |
| FOLH1 AND SELE | Prostate | 0.666667 | 0.5 | 1 |
| FOLH1 AND HPN | Prostate | 1 | 1 | 1 |
| FOLH1 AND CD320 | Prostate | 0.727273 | 0.571429 | 1 |
| FOLH1 AND COLEC12 | Prostate | 0.8 | 0.666667 | 1 |
| FOLH1 AND ATP2C1 | Prostate | 0.666667 | 0.6 | 0.75 |

| Antigen Pair Logic | Cancer (short name) | F1 | Precision | Recall |
|---|---|---|---|---|
| TPBG AND EPCAM | Breast | 0.712644 | 0.939394 | 0.574074 |
| EPCAM AND SLC7A5 | Breast | 0.744681 | 0.875 | 0.648148 |
| FAP AND MSLN | Breast | 0.762887 | 0.860465 | 0.685185 |
| FAP AND ERBB2 | Breast | 0.682927 | 1 | 0.518519 |
| EPCAM AND KDR | Breast | 0.66129 | 0.585714 | 0.759259 |
| EPCAM AND SDC1 | Breast | 0.764045 | 0.971429 | 0.62963 |
| EPCAM AND AXL | Breast | 0.701754 | 0.666667 | 0.740741 |
| EPCAM AND GPNMB | Breast | 0.8 | 0.823529 | 0.777778 |
| EPCAM AND TNC | Breast | 0.632479 | 0.587302 | 0.685185 |
| TPBG AND MSLN | Breast | 0.606061 | 0.666667 | 0.555556 |
| EPCAM AND PCYT1A | Breast | 0.740741 | 0.740741 | 0.740741 |
| EPCAM AND ITGAV | Breast | 0.65625 | 0.567568 | 0.777778 |
| EPCAM AND CBX3 | Breast | 0.722689 | 0.661538 | 0.796296 |
| FAP AND MUC1 | Pancreas | 0.777778 | 1 | 0.636364 |
| FAP AND CD19 | Pancreas | 0.705882 | 1 | 0.545455 |
| FAP AND MSLN | Pancreas | 0.705882 | 1 | 0.545455 |
| CLDN2 AND MSLN | Pancreas | 0.615385 | 0.533333 | 0.727273 |
| FAP AND ERBB2 | Pancreas | 0.705882 | 1 | 0.545455 |
| VCAM1 AND MUC1 | Pancreas | 0.666667 | 0.7 | 0.636364 |
| TNFSF11 AND MUC1 | Pancreas | 0.608696 | 0.583333 | 0.636364 |
| VCAM1 AND ERBB2 | Pancreas | 0.692308 | 0.6 | 0.818182 |
| MUC1 AND ITGAV | Pancreas | 0.727273 | 0.727273 | 0.727273 |
| PTK7 AND MSLN | Pancreas | 0.625 | 1 | 0.454545 |
| STEAP2 AND MUC1 | Pancreas | 0.642857 | 0.529412 | 0.818182 |
| CBX3 AND MUC1 | Colon | 0.666667 | 0.571429 | 0.8 |
| CBX3 AND ERBB2 | Colon | 0.666667 | 0.571429 | 0.8 |
| BIRC5 AND MUC1 | Colon | 0.666667 | 0.5 | 1 |
| ITGAV AND MUC1 | Colon | 0.909091 | 0.833333 | 1 |
| CD33 AND CD70 | AML | 0.872659 | 0.823322 | 0.928287 |
| CD33 AND SLC7A5 | AML | 0.857678 | 0.809187 | 0.912351 |
| CD33 AND PROM1 | AML | 0.757576 | 0.829384 | 0.697211 |
| CD33 AND CD38 | AML | 0.756661 | 0.682692 | 0.848606 |
| CD33 AND TPBG | AML | 0.64486 | 0.779661 | 0.549801 |
| CD33 AND CD34 | AML | 0.631068 | 0.807453 | 0.517928 |
| CD22 AND GPNMB | B-Cell Diffuse | 0.8125 | 0.962963 | 0.702703 |
| MS4A1 AND GPNMB | B-Cell Diffuse | 0.716418 | 0.8 | 0.648649 |
| MS4A1 AND VCAM1 | B-Cell Diffuse | 0.705882 | 0.774194 | 0.648649 |
| CD19 AND GPNMB | B-Cell Diffuse | 0.689655 | 0.952381 | 0.540541 |
| MS4A1 AND SLC7A5 | B-Cell Diffuse | 0.686567 | 0.766667 | 0.621622 |
| MS4A1 AND TPBG | B-Cell Diffuse | 0.676471 | 0.741935 | 0.621622 |
| MS4A1 AND EDNRB | B-Cell Diffuse | 0.657143 | 0.69697 | 0.621622 |
| CD22 AND VCAM1 | B-Cell Diffuse | 0.637363 | 0.537037 | 0.783784 |
| CD19 AND VCAM1 | B-Cell Diffuse | 0.628571 | 0.666667 | 0.594595 |
| MS4A1 AND CLDN12 | B-Cell Diffuse | 0.621622 | 0.621622 | 0.621622 |
| CD19 AND TPBG | B-Cell Diffuse | 0.619718 | 0.647059 | 0.594595 |
| CD19 AND IL2RA | B-Cell Diffuse | 0.60274 | 0.611111 | 0.594595 |
| CD19 AND STEAP2 | Mantle-Cell Lymphoma | 0.914286 | 1 | 0.842105 |
| CD19 AND ERBB2 | Mantle-Cell Lymphoma | 0.914286 | 1 | 0.842105 |
| CD19 AND SDC1 | Mantle-Cell Lymphoma | 0.914286 | 1 | 0.842105 |
| CD19 AND ERBB3 | Mantle-Cell Lymphoma | 0.914286 | 1 | 0.842105 |
| CD19 AND SSTR1 | Mantle-Cell Lymphoma | 0.914286 | 1 | 0.842105 |
| CD19 AND CD34 | Mantle-Cell Lymphoma | 0.914286 | 1 | 0.842105 |
| CD19 AND MUC16 | Mantle-Cell Lymphoma | 0.914286 | 1 | 0.842105 |
| CD19 AND CLDN2 | Mantle-Cell Lymphoma | 0.898551 | 1 | 0.815789 |
| CD19 AND NCAM1 | Mantle-Cell Lymphoma | 0.898551 | 1 | 0.815789 |
| CD19 AND ITGB6 | Mantle-Cell Lymphoma | 0.898551 | 1 | 0.815789 |
| CD19 AND EDNRB | Mantle-Cell Lymphoma | 0.898551 | 1 | 0.815789 |
| CD19 AND GUCY2C | Mantle-Cell Lymphoma | 0.898551 | 1 | 0.815789 |
| CD19 AND ENPP3 | Mantle-Cell Lymphoma | 0.898551 | 1 | 0.815789 |
| CD19 AND LGR5 | Mantle-Cell Lymphoma | 0.898551 | 1 | 0.815789 |
| CD19 AND ERBB4 | Mantle-Cell Lymphoma | 0.898551 | 1 | 0.815789 |
| CD19 AND B4GALNT1 | Mantle-Cell Lymphoma | 0.914286 | 1 | 0.842105 |
| CD19 AND FOLH1 | Mantle-Cell Lymphoma | 0.914286 | 1 | 0.842105 |
| CD19 AND TNFRSF8 | Mantle-Cell Lymphoma | 0.898551 | 1 | 0.815789 |
| CD19 AND SLC39A6 | Mantle-Cell Lymphoma | 0.882353 | 1 | 0.789474 |
| CD19 AND TNFRSF10A | Mantle-Cell Lymphoma | 0.914286 | 1 | 0.842105 |
| CD19 AND PMEL | Mantle-Cell Lymphoma | 0.914286 | 1 | 0.842105 |
| CD19 AND FOLR1 | Mantle-Cell Lymphoma | 0.882353 | 1 | 0.789474 |
| CD19 AND CLDN12 | Mantle-Cell Lymphoma | 0.865672 | 1 | 0.763158 |
| CD19 AND ABCB5 | Mantle-Cell Lymphoma | 0.865672 | 1 | 0.763158 |
| CD19 AND ITGB3 | Mantle-Cell Lymphoma | 0.865672 | 1 | 0.763158 |
| CD19 AND CD52 | Mantle-Cell Lymphoma | 0.898551 | 1 | 0.815789 |
| CD19 AND IL11RA | Mantle-Cell Lymphoma | 0.898551 | 1 | 0.815789 |
| CD19 AND SSTR5 | Mantle-Cell Lymphoma | 0.830769 | 1 | 0.710526 |
| CD19 AND CLDN18 | Mantle-Cell Lymphoma | 0.830769 | 1 | 0.710526 |
| CD19 AND RNF43 | Mantle-Cell Lymphoma | 0.8125 | 1 | 0.684211 |
| CD19 AND CA9 | Mantle-Cell Lymphoma | 0.793651 | 1 | 0.657895 |

FIG. 7 (Cont.)

| Antigen Pair Logic | Cancer (short name) | F1 | Precision | Recall |
|---|---|---|---|---|
| ABCC4 AND FOLH1 | Prostate | 0.857143 | 1 | 0.75 |
| FOLH1 AND CDH26 | Prostate | 0.727273 | 0.571429 | 1 |
| FOLH1 AND CD99 | Prostate | 0.666667 | 0.6 | 0.75 |
| FOLH1 AND SLC2A10 | Prostate | 0.666667 | 1 | 0.5 |
| FOLH1 AND EPHA7 | Prostate | 0.666667 | 0.5 | 1 |
| FOLH1 AND AGTRAP | Prostate | 0.727273 | 0.571429 | 1 |
| FOLH1 AND IL1R1 | Prostate | 0.888889 | 0.8 | 1 |
| FOLH1 AND ITGA5 | Prostate | 0.888889 | 0.8 | 1 |
| FOLH1 AND SDK1 | Prostate | 0.727273 | 0.571429 | 1 |
| FOLH1 AND POPDC2 | Prostate | 0.888889 | 0.8 | 1 |
| FOLH1 AND BBS4 | Prostate | 0.727273 | 0.571429 | 1 |
| FOLH1 AND PPAP2A | Prostate | 0.6 | 0.5 | 0.75 |
| FOLH1 AND KCNMB1 | Prostate | 0.666667 | 0.5 | 1 |
| FOLH1 AND SLC26A4 | Prostate | 0.857143 | 1 | 0.75 |
| NDRG1 AND FOLH1 | Prostate | 0.666667 | 1 | 0.5 |
| FOLH1 AND KIAA0319L | Prostate | 0.75 | 0.75 | 0.75 |
| FOLH1 AND TNFSF4 | Prostate | 0.6 | 0.5 | 0.75 |
| SLC2A12 AND FOLH1 | Prostate | 0.857143 | 1 | 0.75 |
| FOLH1 AND ANKH | Prostate | 0.6 | 0.5 | 0.75 |
| FOLH1 AND OSMR | Prostate | 0.857143 | 1 | 0.75 |
| FOLH1 AND TLCD1 | Prostate | 1 | 1 | 1 |
| FOLH1 AND TUSC3 | Prostate | 0.727273 | 0.571429 | 1 |
| FOLH1 AND SLC10A3 | Prostate | 0.857143 | 1 | 0.75 |
| FOLH1 AND SLC26A6 | Prostate | 0.75 | 0.75 | 0.75 |
| FOLH1 AND FZD4 | Prostate | 1 | 1 | 1 |
| FOLH1 AND SLC7A2 | Prostate | 0.888889 | 0.8 | 1 |
| FOLH1 AND FREM2 | Prostate | 0.888889 | 0.8 | 1 |
| FOLH1 AND MARVELD1 | Prostate | 0.8 | 0.666667 | 1 |
| FOLH1 AND VMP1 | Prostate | 1 | 1 | 1 |
| FOLH1 AND NPR3 | Prostate | 0.75 | 0.75 | 0.75 |
| FOLH1 AND FZD10 | Prostate | 0.727273 | 0.571429 | 1 |
| FOLH1 AND FUT1 | Prostate | 0.75 | 0.75 | 0.75 |
| FOLH1 AND GPR183 | Prostate | 0.666667 | 1 | 0.5 |
| FOLH1 AND C5AR1 | Prostate | 0.75 | 0.75 | 0.75 |
| FOLH1 AND KCNG3 | Prostate | 0.666667 | 1 | 0.5 |
| FOLH1 AND TSPAN2 | Prostate | 0.727273 | 0.571429 | 1 |
| FOLH1 AND CYB5R1 | Prostate | 0.8 | 0.666667 | 1 |
| FOLH1 AND KCNS3 | Prostate | 0.888889 | 0.8 | 1 |
| FOLH1 AND TPM1 | Prostate | 1 | 1 | 1 |
| FOLH1 AND TMPRSS2 | Prostate | 0.727273 | 0.571429 | 1 |
| FOLH1 AND ITGB5 | Prostate | 0.857143 | 1 | 0.75 |
| FOLH1 AND CATSPER2 | Prostate | 0.857143 | 1 | 0.75 |
| FOLH1 AND TRPV1 | Prostate | 0.857143 | 1 | 0.75 |
| FOLH1 AND NOX4 | Prostate | 1 | 1 | 1 |
| FOLH1 AND MYADM | Prostate | 0.857143 | 1 | 0.75 |
| FOLH1 AND OPN1SW | Prostate | 0.857143 | 1 | 0.75 |
| FOLH1 AND VANGL2 | Prostate | 0.666667 | 0.6 | 0.75 |
| FOLH1 AND LMAN2 | Prostate | 0.857143 | 1 | 0.75 |
| FOLH1 AND EPHB4 | Prostate | 0.8 | 0.666667 | 1 |

| Antigen Pair Logic | Cancer (short name) | F1 | Precision | Recall |
|---|---|---|---|---|
| CD19 AND SLC7A5 | Mantle-Cell Lymphoma | 0.793651 | 1 | 0.657895 |
| CD19 AND ROR1 | Mantle-Cell Lymphoma | 0.793651 | 1 | 0.657895 |
| CD19 AND CSPG4 | Mantle-Cell Lymphoma | 0.793651 | 1 | 0.657895 |
| CD19 AND IL2RA | Mantle-Cell Lymphoma | 0.793651 | 1 | 0.657895 |
| CD19 AND EPCAM | Mantle-Cell Lymphoma | 0.774194 | 1 | 0.631579 |
| FCRL2 AND CD19 | Mantle-Cell Lymphoma | 0.754098 | 1 | 0.605263 |
| CD19 AND CLDN9 | Mantle-Cell Lymphoma | 0.754098 | 1 | 0.605263 |
| CD19 AND SLC34A2 | Mantle-Cell Lymphoma | 0.733333 | 1 | 0.578947 |
| CD19 AND VTCN1 | Mantle-Cell Lymphoma | 0.733333 | 1 | 0.578947 |
| CD19 AND GPA33 | Mantle-Cell Lymphoma | 0.711864 | 1 | 0.552632 |
| CD19 AND MUC4 | Mantle-Cell Lymphoma | 0.711864 | 1 | 0.552632 |
| CD19 AND STEAP1 | Mantle-Cell Lymphoma | 0.689655 | 1 | 0.526316 |
| CD19 AND CLDN23 | Mantle-Cell Lymphoma | 0.666667 | 1 | 0.5 |
| CD19 AND CLDN7 | Mantle-Cell Lymphoma | 0.642857 | 1 | 0.473684 |
| CD19 AND IL3RA | Mantle-Cell Lymphoma | 0.642857 | 1 | 0.473684 |
| CD19 AND PROM1 | Mantle-Cell Lymphoma | 0.618182 | 1 | 0.447368 |
| CD19 AND L1CAM | Mantle-Cell Lymphoma | 0.618182 | 1 | 0.447368 |
| MLANA AND TRPM4 | Melanoma | 0.952381 | 1 | 0.909091 |
| MLANA AND IL11RA | Melanoma | 1 | 1 | 1 |
| MLANA AND L1CAM | Melanoma | 0.952381 | 1 | 0.909091 |
| EDNRB AND PMEL | Melanoma | 0.9 | 1 | 0.818182 |
| EDNRB AND MLANA | Melanoma | 0.9 | 1 | 0.818182 |
| PMEL AND CD22 | Melanoma | 0.9 | 1 | 0.818182 |
| MLANA AND MET | Melanoma | 0.842105 | 1 | 0.727273 |
| MLANA AND IL13RA1 | Melanoma | 0.842105 | 1 | 0.727273 |
| PMEL AND ITGAV | Melanoma | 0.842105 | 1 | 0.727273 |
| CBX3 AND B4GALNT1 | Neuroblastoma | 0.625954 | 0.87234 | 0.488095 |
| B4GALNT1 AND CD276 | Neuroblastoma | 0.629371 | 0.762712 | 0.535714 |
| STEAP2 AND FOLH1 | Prostate | 0.727273 | 0.571429 | 1 |
| STEAP1 AND FOLH1 | Prostate | 0.75 | 0.75 | 0.75 |
| FOLH1 AND EPHA3 | Prostate | 0.8 | 0.666667 | 1 |
| FOLH1 AND GPNMB | Prostate | 0.666667 | 1 | 0.5 |
| FOLH1 AND FLOT2 | Prostate | 0.666667 | 0.5 | 1 |
| FOLH1 AND ROR1 | Prostate | 0.888889 | 0.8 | 1 |
| FOLH1 AND TNC | Prostate | 0.888889 | 0.8 | 1 |
| FOLH1 AND EPCAM | Prostate | 0.857143 | 1 | 0.75 |
| FOLH1 AND CLDN8 | Prostate | 0.8 | 0.666667 | 1 |
| FOLH1 AND TPBG | Prostate | 0.6 | 0.5 | 0.75 |
| FOLH1 AND CLDN12 | Prostate | 0.666667 | 1 | 0.5 |
| FOLH1 AND HSPA5 | Prostate | 0.666667 | 1 | 0.5 |
| FOLH1 AND CD38 | Prostate | 0.727273 | 0.571429 | 1 |
| FOLH1 AND IL20RA | Prostate | 0.8 | 0.666667 | 1 |
| FOLH1 AND DKK1 | Prostate | 0.727273 | 0.571429 | 1 |
| FOLH1 AND PTK7 | Prostate | 0.615385 | 0.444444 | 1 |
| FOLH1 AND MOK | Prostate | 0.666667 | 1 | 0.5 |
| FOLH1 AND ERBB2 | Prostate | 0.615385 | 0.444444 | 1 |
| FOLH1 AND CBX3 | Prostate | 0.857143 | 1 | 0.75 |
| FOLH1 AND MUC1 | Prostate | 0.888889 | 0.8 | 1 |
| FOLH1 AND CD52 | Prostate | 0.75 | 0.75 | 0.75 |
| FOLH1 AND ABCA5 | Prostate | 0.666667 | 1 | 0.5 |

FIG. 8

| Antigen Pair Logic | Cancer (short name) | F1 | Precision | Recall |
|---|---|---|---|---|
| PTPRZ1 AND ITGB8 | Astrocytoma | 0.904762 | 1 | 0.826087 |
| PTPRZ1 AND ITM2B | Astrocytoma | 0.876404 | 0.906977 | 0.847826 |
| PTPRZ1 AND MPZL1 | Astrocytoma | 0.904762 | 1 | 0.826087 |
| PTPRZ1 AND SLC44A2 | Astrocytoma | 0.857143 | 0.866667 | 0.847826 |
| PTPRZ1 AND CSF1R | Astrocytoma | 0.847826 | 0.847826 | 0.847826 |
| PLP1 AND F2RL1 | Astrocytoma | 0.843373 | 0.945946 | 0.76087 |
| PTPRZ1 AND ABCA1 | Astrocytoma | 0.835443 | 1 | 0.717391 |
| PTPRZ1 AND NRCAM | Astrocytoma | 0.833333 | 0.8 | 0.869565 |
| PTPRZ1 AND ATP8B4 | Astrocytoma | 0.829268 | 0.944444 | 0.73913 |
| PTPRZ1 AND CLCN5 | Astrocytoma | 0.828283 | 0.773585 | 0.891304 |
| PTPRZ1 AND BMP2 | Astrocytoma | 0.827586 | 0.878049 | 0.782609 |
| PTPRZ1 AND VANGL2 | Astrocytoma | 0.826087 | 0.826087 | 0.826087 |
| PLP1 AND ABCA1 | Astrocytoma | 0.825 | 0.970588 | 0.717391 |
| PTPRZ1 AND CD320 | Astrocytoma | 0.822222 | 0.840909 | 0.804348 |
| PTPRZ1 AND CSF2RB | Astrocytoma | 0.820513 | 1 | 0.695652 |
| PTPRZ1 AND ADAM28 | Astrocytoma | 0.820513 | 1 | 0.695652 |
| PTPRZ1 AND ANTXR1 | Astrocytoma | 0.819277 | 0.918919 | 0.73913 |
| PTPRZ1 AND ADAM17 | Astrocytoma | 0.818182 | 0.857143 | 0.782609 |
| PTPRZ1 AND DDR2 | Astrocytoma | 0.817204 | 0.808511 | 0.826087 |
| PTPRZ1 AND LRRC8D | Astrocytoma | 0.816327 | 0.769231 | 0.869565 |
| PTPRZ1 AND DLL1 | Astrocytoma | 0.818182 | 0.857143 | 0.782609 |
| PTPRZ1 AND AGTRAP | Astrocytoma | 0.814815 | 0.942857 | 0.717391 |
| PTPRZ1 AND CD68 | Astrocytoma | 0.814815 | 0.942857 | 0.717391 |
| NRCAM AND TSPAN11 | Astrocytoma | 0.813953 | 0.875 | 0.76087 |
| PTPRZ1 AND MACF1 | Astrocytoma | 0.813187 | 0.822222 | 0.804348 |
| PTPRZ1 AND BMPR1A | Astrocytoma | 0.811881 | 0.745455 | 0.891304 |
| AQP4 AND VANGL2 | Astrocytoma | 0.808989 | 0.837209 | 0.782609 |
| PTPRZ1 AND BVES | Astrocytoma | 0.808989 | 0.837209 | 0.782609 |
| PLP1 AND MPZL1 | Astrocytoma | 0.804878 | 0.916667 | 0.717391 |
| NRCAM AND F2RL1 | Astrocytoma | 0.804348 | 0.804348 | 0.804348 |
| PTPRZ1 AND PCDHB2 | Astrocytoma | 0.804124 | 0.764706 | 0.847826 |
| SLC1A3 AND VANGL2 | Astrocytoma | 0.804124 | 0.764706 | 0.847826 |
| FAIM2 AND VANGL2 | Astrocytoma | 0.8 | 0.818182 | 0.782609 |
| PTPRZ1 AND SLCO2B1 | Astrocytoma | 0.8 | 0.941176 | 0.695652 |
| NRCAM AND HAS2 | Astrocytoma | 0.8 | 0.871795 | 0.73913 |
| FAIM2 AND F2RL1 | Astrocytoma | 0.8 | 0.871795 | 0.73913 |
| AQP4 AND TSPAN11 | Astrocytoma | 0.8 | 0.871795 | 0.73913 |
| PTPRZ1 AND TSPAN11 | Astrocytoma | 0.8 | 0.871795 | 0.73913 |
| NRCAM AND VANGL2 | Astrocytoma | 0.8 | 0.871795 | 0.73913 |
| PTPRZ1 AND CACNA1F | Astrocytoma | 0.795918 | 0.75 | 0.847826 |
| APLP1 AND VANGL2 | Astrocytoma | 0.795918 | 0.75 | 0.847826 |
| PTPRZ1 AND MERTK | Astrocytoma | 0.795699 | 0.787234 | 0.804348 |
| NRCAM AND BMPR1A | Astrocytoma | 0.795455 | 0.833333 | 0.76087 |
| PTPRZ1 AND TSPAN12 | Astrocytoma | 0.795455 | 0.833333 | 0.76087 |
| PTPRZ1 AND IL12RB1 | Astrocytoma | 0.795455 | 0.833333 | 0.76087 |
| PTPRZ1 AND ATP13A4 | Astrocytoma | 0.794872 | 0.96875 | 0.673913 |
| ADAM22 AND SLC3A2 | Astrocytoma | 0.791209 | 0.8 | 0.782609 |
| PTPRZ1 AND CSF1 | Astrocytoma | 0.791209 | 0.8 | 0.782609 |
| NRCAM AND TSPAN12 | Astrocytoma | 0.790698 | 0.85 | 0.73913 |
| PTPRZ1 AND ADAM9 | Astrocytoma | 0.790698 | 0.85 | 0.73913 |
| PTPRZ1 AND FCGRT | Astrocytoma | 0.789474 | 1 | 0.652174 |
| PTPRZ1 AND CLEC4A | Astrocytoma | 0.789474 | 1 | 0.652174 |
| GPM6B AND F2RL1 | Astrocytoma | 0.789474 | 1 | 0.652174 |
| PTPRZ1 AND PANX1 | Astrocytoma | 0.788462 | 0.706897 | 0.891304 |
| PTPRZ1 AND C5AR1 | Astrocytoma | 0.787234 | 0.770833 | 0.804348 |
| PLP1 AND VANGL2 | Astrocytoma | 0.786517 | 0.813953 | 0.76087 |
| NRCAM AND ABCC4 | Astrocytoma | 0.785714 | 0.868421 | 0.717391 |
| CADM2 AND F2RL1 | Astrocytoma | 0.785714 | 0.868421 | 0.717391 |
| GPM6B AND HAS2 | Astrocytoma | 0.78481 | 0.939394 | 0.673913 |
| PTPRZ1 AND SLC1A3 | Astrocytoma | 0.784314 | 0.714286 | 0.869565 |
| PTPRZ1 AND ATP13A1 | Astrocytoma | 0.784314 | 0.714286 | 0.869565 |
| PTPRZ1 AND KCNJ8 | Astrocytoma | 0.784314 | 0.714286 | 0.869565 |
| ADAM22 AND VANGL2 | Astrocytoma | 0.808989 | 0.837209 | 0.782609 |
| PTPRZ1 AND ATP6AP2 | Astrocytoma | 0.783505 | 0.745098 | 0.826087 |
| PCDH17 AND TSPAN11 | Astrocytoma | 0.782609 | 0.782609 | 0.782609 |
| PTPRZ1 AND HTRA2 | Astrocytoma | 0.782609 | 0.782609 | 0.782609 |
| PTPRZ1 AND CCR5 | Astrocytoma | 0.789474 | 1 | 0.652174 |
| PLP1 AND TSPAN12 | Astrocytoma | 0.781609 | 0.829268 | 0.73913 |
| PTPRZ1 AND P2RY1 | Astrocytoma | 0.780952 | 0.694915 | 0.891304 |
| PTPRZ1 AND CLEC1A | Astrocytoma | 0.780952 | 0.694915 | 0.891304 |
| PTPRZ1 AND TPCN2 | Astrocytoma | 0.780952 | 0.694915 | 0.891304 |
| PTPRZ1 AND TMEM119 | Astrocytoma | 0.779221 | 0.967742 | 0.652174 |
| PTPRZ1 AND SRR | Astrocytoma | 0.778947 | 0.755102 | 0.804348 |
| ADAM22 AND TSPAN12 | Astrocytoma | 0.777778 | 0.795455 | 0.76087 |
| PLP1 AND SNAP23 | Astrocytoma | 0.777778 | 0.795455 | 0.76087 |
| ADAM12 AND PMEPA1 | Breast | 0.857143 | 0.882353 | 0.833333 |
| ADAM12 AND JAG2 | Breast | 0.854167 | 0.97619 | 0.759259 |

| Antigen Pair Logic | Cancer (short name) | F1 | Precision | Recall |
|---|---|---|---|---|
| STEAP2 AND STEAP4 | Prostate | 0.857143 | 1 | 0.75 |
| STEAP1 AND CDH10 | Prostate | 0.857143 | 1 | 0.75 |
| STEAP2 AND ADAM2 | Prostate | 0.857143 | 1 | 0.75 |
| STEAP2 AND ATP8A2 | Prostate | 0.75 | 0.75 | 0.75 |
| STEAP2 AND CSPG5 | Prostate | 0.857143 | 1 | 0.75 |
| STEAP2 AND FLVCR1 | Prostate | 0.8 | 0.666667 | 1 |
| STEAP1 AND GABRG3 | Prostate | 0.75 | 0.75 | 0.75 |
| STEAP1 AND PCDH15 | Prostate | 0.75 | 0.75 | 0.75 |
| STEAP1 AND TMEFF2 | Prostate | 0.75 | 0.75 | 0.75 |
| STEAP1 AND PCDH8 | Prostate | 0.75 | 0.75 | 0.75 |
| STEAP1 AND TTYH3 | Prostate | 0.75 | 0.75 | 0.75 |
| STEAP1 AND NKAIN1 | Prostate | 0.857143 | 1 | 0.75 |
| STEAP2 AND IL15RA | Prostate | 0.727273 | 0.571429 | 1 |
| STEAP2 AND UMODL1 | Prostate | 0.727273 | 0.571429 | 1 |
| STEAP2 AND NMBR | Prostate | 0.727273 | 0.571429 | 1 |
| STEAP2 AND PCDHB1 | Prostate | 0.727273 | 0.571429 | 1 |
| STEAP2 AND GRM6 | Prostate | 0.727273 | 0.571429 | 1 |
| STEAP2 AND GRM5 | Prostate | 0.727273 | 0.571429 | 1 |
| STEAP2 AND TAS1R1 | Prostate | 0.727273 | 0.571429 | 1 |
| STEAP2 AND CHRNB4 | Prostate | 0.727273 | 0.571429 | 1 |
| STEAP2 AND ATP6V0A4 | Prostate | 0.727273 | 0.571429 | 1 |
| STEAP2 AND SLC13A2 | Prostate | 0.727273 | 0.571429 | 1 |
| STEAP2 AND ZACN | Prostate | 0.727273 | 0.571429 | 1 |
| STEAP2 AND CHRNG | Prostate | 0.727273 | 0.571429 | 1 |
| STEAP2 AND KCNA7 | Prostate | 0.727273 | 0.571429 | 1 |
| STEAP2 AND ATP13A5 | Prostate | 0.727273 | 0.571429 | 1 |
| STEAP2 AND GLRA3 | Prostate | 0.727273 | 0.571429 | 1 |
| STEAP2 AND AGTR2 | Prostate | 0.727273 | 0.571429 | 1 |
| STEAP2 AND KCNQ2 | Prostate | 0.727273 | 0.571429 | 1 |
| STEAP2 AND HTR5A | Prostate | 0.727273 | 0.571429 | 1 |
| STEAP2 AND DSC1 | Prostate | 0.727273 | 0.571429 | 1 |
| STEAP2 AND HTR1F | Prostate | 0.727273 | 0.571429 | 1 |
| STEAP2 AND ACSL6 | Prostate | 0.727273 | 0.571429 | 1 |
| STEAP2 AND TTYH3 | Prostate | 0.727273 | 0.571429 | 1 |
| STEAP2 AND SLC9B1 | Prostate | 0.727273 | 0.571429 | 1 |
| STEAP2 AND OR8B2 | Prostate | 0.727273 | 0.571429 | 1 |
| STEAP2 AND ADAM21 | Prostate | 0.727273 | 0.571429 | 1 |
| STEAP2 AND GPR78 | Prostate | 0.727273 | 0.571429 | 1 |
| STEAP2 AND GHSR | Prostate | 0.727273 | 0.571429 | 1 |
| STEAP2 AND GHRHR | Prostate | 0.727273 | 0.571429 | 1 |
| STEAP2 AND PCDHA9 | Prostate | 0.727273 | 0.571429 | 1 |
| STEAP2 AND CCR9 | Prostate | 0.727273 | 0.571429 | 1 |
| STEAP2 AND KCNK16 | Prostate | 0.727273 | 0.571429 | 1 |
| STEAP2 AND PRND | Prostate | 0.727273 | 0.571429 | 1 |
| STEAP2 AND KIRREL2 | Prostate | 0.727273 | 0.571429 | 1 |
| STEAP2 AND CD74 | Prostate | 0.727273 | 0.571429 | 1 |
| STEAP2 AND CD44 | Prostate | 0.727273 | 0.571429 | 1 |
| STEAP2 AND MEGF11 | Prostate | 0.727273 | 0.571429 | 1 |
| STEAP2 AND TMPRSS11D | Prostate | 0.727273 | 0.571429 | 1 |
| STEAP2 AND CNTNAP2 | Prostate | 0.727273 | 0.571429 | 1 |
| STEAP2 AND GNRHR | Prostate | 0.727273 | 0.571429 | 1 |
| STEAP2 AND EPHA10 | Prostate | 0.727273 | 0.571429 | 1 |
| FAP AND TGFBI | Sarcoma | 0.785714 | 1 | 0.647059 |
| FAP AND LAPTM5 | Sarcoma | 0.827586 | 1 | 0.705882 |
| FAP AND CD163 | Sarcoma | 0.827586 | 1 | 0.705882 |
| TGFBI AND ULBP2 | Sarcoma | 0.692308 | 1 | 0.529412 |
| FAP AND SLC1A5 | Sarcoma | 0.692308 | 1 | 0.529412 |
| FAP AND SLC31A1 | Sarcoma | 0.785714 | 1 | 0.647059 |
| CDH17 AND SPON2 | Stomach | 0.896552 | 0.886364 | 0.906977 |
| CDH17 AND THY1 | Stomach | 0.767677 | 0.678571 | 0.883721 |
| CDH17 AND CLDN1 | Stomach | 0.921348 | 0.891304 | 0.953488 |
| CLDN18 AND FAT1 | Stomach | 0.864198 | 0.921053 | 0.813953 |
| CLDN18 AND CDH17 | Stomach | 0.897436 | 1 | 0.813953 |
| CLDN18 AND SLC2A1 | Stomach | 0.847059 | 0.857143 | 0.837209 |
| CLDN18 AND TTYH3 | Stomach | 0.843373 | 0.875 | 0.813953 |
| CLDN18 AND PCDHA6 | Stomach | 0.747253 | 0.708333 | 0.790698 |
| CLDN18 AND ATP4B | Stomach | 0.769231 | 0.729167 | 0.813953 |
| CDH17 AND PSCA | Stomach | 0.739726 | 0.9 | 0.627907 |
| CLDN18 AND ABCG5 | Stomach | 0.786517 | 0.76087 | 0.813953 |
| CLDN18 AND VANGL1 | Stomach | 0.875 | 0.945946 | 0.813953 |
| MUC13 AND BST2 | Stomach | 0.837838 | 1 | 0.72093 |
| CLDN18 AND F2R | Stomach | 0.86747 | 0.9 | 0.837209 |
| CLDN18 AND RXFP3 | Stomach | 0.738095 | 0.756098 | 0.72093 |
| CLDN18 AND FLVCR1 | Stomach | 0.809524 | 0.829268 | 0.790698 |
| CLDN18 AND LRIG3 | Stomach | 0.860759 | 0.944444 | 0.790698 |
| CLDN18 AND ABHD3 | Stomach | 0.864198 | 0.921053 | 0.813953 |
| CLDN18 AND ATP8B1 | Stomach | 0.837838 | 1 | 0.72093 |

FIG. 8 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND CELSR2 | Breast | 0.851485 | 0.914894 | 0.796296 | CLDN18 AND KCNC2 | Stomach | 0.767442 | 0.767442 | 0.767442 |
| ADAM12 AND TSPAN17 | Breast | 0.851064 | 1 | 0.740741 | CDH17 AND FAP | Stomach | 0.837209 | 0.837209 | 0.837209 |
| ADAM12 AND CNNM4 | Breast | 0.851064 | 1 | 0.740741 | CLDN18 AND KCNK12 | Stomach | 0.759494 | 0.833333 | 0.697674 |
| ADAM12 AND SLC9A7 | Breast | 0.851485 | 0.914894 | 0.796296 | CLDN18 AND ENPP1 | Stomach | 0.755556 | 0.723404 | 0.790698 |
| ADAM12 AND CX3CL1 | Breast | 0.849057 | 0.865385 | 0.833333 | CLDN18 AND LHFPL5 | Stomach | 0.765957 | 0.705882 | 0.837209 |
| ADAM12 AND CD9 | Breast | 0.848485 | 0.933333 | 0.777778 | MUC13 AND ESAM | Stomach | 0.851064 | 0.784314 | 0.930233 |
| ADAM12 AND UNC5B | Breast | 0.842105 | 0.97561 | 0.740741 | MUC13 AND F2R | Stomach | 0.857143 | 0.763636 | 0.976744 |
| ADAM12 AND CELSR1 | Breast | 0.841121 | 0.849057 | 0.833333 | CLDN18 AND GJB4 | Stomach | 0.704545 | 0.688889 | 0.72093 |
| ADAM12 AND SLC12A7 | Breast | 0.83871 | 1 | 0.722222 | CLDN18 AND PPAPDC1B | Stomach | 0.847059 | 0.857143 | 0.837209 |
| ADAM12 AND KIAA1324 | Breast | 0.834951 | 0.877551 | 0.796296 | MST1R AND BST2 | Stomach | 0.837838 | 1 | 0.72093 |
| ADAM12 AND GJB2 | Breast | 0.834951 | 0.877551 | 0.796296 | CDH17 AND SLC7A5 | Stomach | 0.72549 | 0.627119 | 0.860465 |
| ADAM12 AND CXADR | Breast | 0.826923 | 0.86 | 0.796296 | CLDN18 AND GRIK4 | Stomach | 0.781609 | 0.772727 | 0.790698 |
| ADAM12 AND SLC27A1 | Breast | 0.824742 | 0.930233 | 0.740741 | CLDN18 AND CDH20 | Stomach | 0.765432 | 0.815789 | 0.72093 |
| ADAM12 AND ACVR1B | Breast | 0.823529 | 0.875 | 0.777778 | CLDN18 AND MLNR | Stomach | 0.771084 | 0.8 | 0.744186 |
| ADAM12 AND ST14 | Breast | 0.821053 | 0.95122 | 0.722222 | CLDN18 AND PCDHAC2 | Stomach | 0.795455 | 0.777778 | 0.813953 |
| ADAM12 AND PROM2 | Breast | 0.821053 | 0.95122 | 0.722222 | CLDN18 AND CACNA1B | Stomach | 0.758621 | 0.75 | 0.767442 |
| ADAM12 AND CCR5 | Breast | 0.818182 | 0.803571 | 0.833333 | CLDN18 AND LRRC55 | Stomach | 0.782609 | 0.734694 | 0.837209 |
| ADAM12 AND ABCA3 | Breast | 0.817204 | 0.974359 | 0.703704 | CLDN18 AND LCT | Stomach | 0.765957 | 0.705882 | 0.837209 |
| ADAM12 AND LSR | Breast | 0.817204 | 0.974359 | 0.703704 | CLDN18 AND CACNG6 | Stomach | 0.765957 | 0.705882 | 0.837209 |
| ADAM12 AND LAX1 | Breast | 0.807339 | 0.8 | 0.814815 | CLDN18 AND PAQR8 | Stomach | 0.837838 | 1 | 0.72093 |
| ADAM12 AND ITGA11 | Breast | 0.804348 | 0.973684 | 0.685185 | CLDN18 AND LRFN2 | Stomach | 0.8 | 0.809524 | 0.790698 |
| ADAM12 AND PLXDC1 | Breast | 0.804124 | 0.906977 | 0.722222 | CLDN18 AND DIO1 | Stomach | 0.705882 | 0.714286 | 0.697674 |
| ADAM12 AND ITGAX | Breast | 0.8 | 0.926829 | 0.703704 | CLDN18 AND GALR2 | Stomach | 0.790123 | 0.842105 | 0.744186 |
| ADAM12 AND IL17RB | Breast | 0.8 | 0.869565 | 0.740741 | CLDN18 AND OPRM1 | Stomach | 0.777778 | 0.744681 | 0.813953 |
| FGG AND SLC26A6 | Liver | 0.923077 | 0.857143 | 1 | CLDN18 AND KCNH1 | Stomach | 0.755556 | 0.723404 | 0.790698 |
| FGG AND LRRC8D | Liver | 0.909091 | 1 | 0.833333 | CLDN18 AND ABCA12 | Stomach | 0.777778 | 0.744681 | 0.813953 |
| FGG AND SLC38A6 | Liver | 0.909091 | 1 | 0.833333 | CLDN18 AND OR52D1 | Stomach | 0.764045 | 0.73913 | 0.790698 |
| FGG AND HM13 | Liver | 1 | 1 | 1 | CLDN18 AND GPR135 | Stomach | 0.808989 | 0.782609 | 0.837209 |
| FGG AND SLC39A1 | Liver | 0.909091 | 1 | 0.833333 | CLDN18 AND CALHM1 | Stomach | 0.752688 | 0.7 | 0.813953 |
| FGG AND NCSTN | Liver | 1 | 1 | 1 | CLDN18 AND FSHR | Stomach | 0.725275 | 0.6875 | 0.767442 |
| FGG AND C6orf89 | Liver | 1 | 1 | 1 | CEACAM5 AND BST2 | Stomach | 0.771429 | 1 | 0.627907 |
| FGG AND LRP11 | Liver | 1 | 1 | 1 | CLDN18 AND GJA3 | Stomach | 0.771084 | 0.8 | 0.744186 |
| FGG AND ATP2A2 | Liver | 0.909091 | 1 | 0.833333 | CLDN18 AND GPR158 | Stomach | 0.755556 | 0.723404 | 0.790698 |
| FGG AND ADCY6 | Liver | 0.909091 | 1 | 0.833333 | ATP8B1 AND THY1 | Stomach | 0.871795 | 0.971429 | 0.790698 |
| FGG AND FGFRL1 | Liver | 1 | 1 | 1 | CLDN18 AND SLC22A11 | Stomach | 0.712644 | 0.704545 | 0.72093 |
| FGG AND CELSR3 | Liver | 0.857143 | 0.75 | 1 | CLDN18 AND P2RY4 | Stomach | 0.765957 | 0.705882 | 0.837209 |
| FGG AND ANO10 | Liver | 0.909091 | 1 | 0.833333 | CLDN18 AND ABCG4 | Stomach | 0.853659 | 0.897436 | 0.813953 |
| FGG AND NIPA1 | Liver | 0.909091 | 1 | 0.833333 | CLDN18 AND UMOD | Stomach | 0.719101 | 0.695652 | 0.744186 |
| FGG AND SLC17A5 | Liver | 0.909091 | 1 | 0.833333 | CLDN18 AND CEACAM7 | Stomach | 0.813953 | 0.813953 | 0.813953 |
| HPN AND SLC26A6 | Liver | 1 | 1 | 1 | MUC17 AND CLDN1 | Stomach | 0.853333 | 1 | 0.744186 |
| TFR2 AND SLC26A6 | Liver | 0.833333 | 0.833333 | 0.833333 | MUC13 AND IFI6 | Stomach | 0.729412 | 0.738095 | 0.72093 |
| FGG AND TSPAN17 | Liver | 0.909091 | 1 | 0.833333 | CLDN18 AND CACNG8 | Stomach | 0.818182 | 0.8 | 0.837209 |
| FGG AND CLN3 | Liver | 0.909091 | 1 | 0.833333 | CLDN18 AND CLRN1 | Stomach | 0.76087 | 0.714286 | 0.813953 |
| FGG AND NOX4 | Liver | 0.923077 | 0.857143 | 1 | CLDN18 AND CACNG2 | Stomach | 0.75 | 0.733333 | 0.767442 |
| FGG AND SLC26A11 | Liver | 0.909091 | 1 | 0.833333 | CLDN18 AND NPHS1 | Stomach | 0.791209 | 0.75 | 0.837209 |
| FGG AND NPBWR2 | Liver | 0.909091 | 1 | 0.833333 | CLDN18 AND GRIN2B | Stomach | 0.755556 | 0.723404 | 0.790698 |
| FGG AND ABCB8 | Liver | 0.857143 | 0.75 | 1 | CLDN18 AND GABBR2 | Stomach | 0.711111 | 0.680851 | 0.744186 |
| FGG AND PANX2 | Liver | 1 | 1 | 1 | CLDN18 AND SLC17A1 | Stomach | 0.769231 | 0.729167 | 0.813953 |
| FGG AND PIGU | Liver | 0.8 | 1 | 0.666667 | CLDN18 AND CALY | Stomach | 0.823529 | 0.833333 | 0.813953 |
| FGG AND PHEX | Liver | 1 | 1 | 1 | CLDN18 AND SEZ6 | Stomach | 0.769231 | 0.729167 | 0.813953 |
| FGG AND TMEM8B | Liver | 0.8 | 1 | 0.666667 | PTPRZ1 AND CD33 | Astrocytoma | 0.829787 | 0.8125 | 0.847826 |
| FGG AND PDCD1 | Liver | 0.909091 | 1 | 0.833333 | PTPRZ1 AND VCAM1 | Astrocytoma | 0.811881 | 0.745455 | 0.891304 |
| FGG AND MRAP2 | Liver | 0.8 | 0.666667 | 1 | PTPRZ1 AND CD38 | Astrocytoma | 0.764706 | 0.696429 | 0.847826 |
| FGG AND YIPF3 | Liver | 0.909091 | 1 | 0.833333 | PTPRZ1 AND CD79A | Astrocytoma | 0.761905 | 0.677966 | 0.869565 |
| FGG AND SPPL3 | Liver | 0.8 | 1 | 0.666667 | NCAM1 AND VANGL2 | Astrocytoma | 0.758621 | 0.804878 | 0.717391 |
| FGG AND CNNM3 | Liver | 0.8 | 0.666667 | 1 | PTPRZ1 AND EDNRB | Astrocytoma | 0.758621 | 0.804878 | 0.717391 |
| FGG AND OPRD1 | Liver | 1 | 1 | 1 | ADCYAP1R1 AND CD33 | Astrocytoma | 0.758621 | 0.804878 | 0.717391 |
| FGG AND ADORA2B | Liver | 0.909091 | 1 | 0.833333 | NRCAM AND CD33 | Astrocytoma | 0.755102 | 0.711538 | 0.804348 |
| FGG AND IGF2R | Liver | 0.909091 | 1 | 0.833333 | PTPRZ1 AND MS4A1 | Astrocytoma | 0.75 | 0.672414 | 0.847826 |
| FGG AND ATP9B | Liver | 0.8 | 1 | 0.666667 | PTPRZ1 AND NCAM1 | Astrocytoma | 0.745455 | 0.640625 | 0.891304 |
| ASGR1 AND SMO | Liver | 0.8 | 1 | 0.666667 | PTPRZ1 AND BMPR1B | Astrocytoma | 0.733945 | 0.634921 | 0.869565 |
| FGG AND MMP14 | Liver | 1 | 1 | 1 | PTPRZ1 AND L1CAM | Astrocytoma | 0.733945 | 0.634921 | 0.869565 |
| FGG AND SLC5A5 | Liver | 0.909091 | 1 | 0.833333 | PTPRZ1 AND P2RX5 | Astrocytoma | 0.728972 | 0.639344 | 0.847826 |
| FGG AND SLC2A5 | Liver | 0.909091 | 1 | 0.833333 | PTPRZ1 AND ITGB3 | Astrocytoma | 0.725275 | 0.733333 | 0.717391 |
| FGG AND SMO | Liver | 0.8 | 1 | 0.666667 | PTPRZ1 AND TNFRSF10A | Astrocytoma | 0.717391 | 0.717391 | 0.717391 |
| FGG AND STIM1 | Liver | 0.909091 | 1 | 0.833333 | PTPRZ1 AND GUCY2C | Astrocytoma | 0.717391 | 0.717391 | 0.717391 |
| FGG AND STX4 | Liver | 0.8 | 1 | 0.666667 | NRCAM AND MUC1 | Astrocytoma | 0.716981 | 0.633333 | 0.826087 |
| FGG AND TMEM67 | Liver | 0.8 | 0.666667 | 1 | PTPRZ1 AND FCRL5 | Astrocytoma | 0.715789 | 0.693878 | 0.73913 |
| SLC27A5 AND SLC26A6 | Liver | 0.923077 | 0.857143 | 1 | PTPRZ1 AND FAP | Astrocytoma | 0.712644 | 0.756098 | 0.673913 |
| FGG AND PLXNC1 | Liver | 0.8 | 1 | 0.666667 | PTPRZ1 AND CLDN18 | Astrocytoma | 0.709677 | 0.702128 | 0.717391 |
| FGG AND MFSD5 | Liver | 0.8 | 1 | 0.666667 | PTPRZ1 AND FCRL2 | Astrocytoma | 0.709677 | 0.702128 | 0.717391 |
| FGG AND DAGLB | Liver | 0.8 | 1 | 0.666667 | PTPRZ1 AND CLDN2 | Astrocytoma | 0.709677 | 0.702128 | 0.717391 |
| FGG AND TMPRSS5 | Liver | 0.8 | 0.666667 | 1 | NCAM1 AND ABCA1 | Astrocytoma | 0.708861 | 0.848485 | 0.608696 |
| FGG AND KCNG3 | Liver | 0.8 | 0.666667 | 1 | NCAM1 AND TSPAN11 | Astrocytoma | 0.708333 | 0.68 | 0.73913 |
| FGG AND SLC4A11 | Liver | 0.833333 | 0.833333 | 0.833333 | PTPRZ1 AND TNFRSF13C | Astrocytoma | 0.705882 | 0.769231 | 0.652174 |
| FGG AND CRHR1 | Liver | 0.8 | 1 | 0.666667 | PTPRZ1 AND CD276 | Astrocytoma | 0.704545 | 0.738095 | 0.673913 |
| SLC39A14 AND OLR1 | Pancreas | 0.736842 | 0.875 | 0.636364 | PTPRZ1 AND IL2RA | Astrocytoma | 0.703297 | 0.711111 | 0.695652 |

FIG. 8 (Cont.)

| Antigen Pair Logic | Cancer (short name) | F1 | Precision | Recall |
|---|---|---|---|---|
| KCNE4 AND NTM | Pancreas | 0.7 | 0.777778 | 0.636364 |
| KCNE4 AND SYT13 | Pancreas | 0.695652 | 0.666667 | 0.727273 |
| NOX4 AND TM4SF1 | Pancreas | 0.777778 | 1 | 0.636364 |
| NOX4 AND ADAM28 | Pancreas | 0.705882 | 1 | 0.545455 |
| NOX4 AND LITAF | Pancreas | 0.705882 | 1 | 0.545455 |
| TNFSF4 AND SYT13 | Pancreas | 0.736842 | 0.875 | 0.636364 |
| KCNE4 AND MARCH1 | Pancreas | 0.666667 | 0.615385 | 0.727273 |
| KCNE4 AND IGSF6 | Pancreas | 0.666667 | 0.615385 | 0.727273 |
| KCNE4 AND FAM26F | Pancreas | 0.666667 | 0.615385 | 0.727273 |
| KCNE4 AND TACSTD2 | Pancreas | 0.666667 | 0.7 | 0.636364 |
| KCNE4 AND TSPAN8 | Pancreas | 0.736842 | 0.875 | 0.636364 |
| TREM2 AND TNFSF4 | Pancreas | 0.705882 | 1 | 0.545455 |
| SYT13 AND ATP10D | Pancreas | 0.727273 | 0.727273 | 0.727273 |
| SYT13 AND LRRC32 | Pancreas | 0.72 | 0.642857 | 0.818182 |
| KCNE4 AND SLC41A2 | Pancreas | 0.666667 | 0.857143 | 0.545455 |
| KCNE4 AND GPRC5A | Pancreas | 0.666667 | 0.857143 | 0.545455 |
| NOX4 AND CXCR4 | Pancreas | 0.666667 | 0.857143 | 0.545455 |
| KCNE4 AND SLC7A7 | Pancreas | 0.666667 | 0.615385 | 0.727273 |
| KCNE4 AND CD48 | Pancreas | 0.666667 | 0.615385 | 0.727273 |
| KCNE4 AND SLC44A3 | Pancreas | 0.695652 | 0.666667 | 0.727273 |
| KCNE4 AND LSR | Pancreas | 0.666667 | 0.857143 | 0.545455 |
| TNFSF13B AND SYT13 | Pancreas | 0.842105 | 1 | 0.727273 |
| TNFSF4 AND DSG2 | Pancreas | 0.736842 | 0.875 | 0.636364 |
| VSIG1 AND GJA1 | Pancreas | 0.666667 | 0.857143 | 0.545455 |
| NOX4 AND SLC38A5 | Pancreas | 0.695652 | 0.666667 | 0.727273 |
| OSMR AND SYT13 | Pancreas | 0.666667 | 0.7 | 0.636364 |
| KCNE4 AND ABCC8 | Pancreas | 0.736842 | 0.875 | 0.636364 |
| GP2 AND TLR2 | Pancreas | 0.777778 | 1 | 0.636364 |
| NTM AND DSG2 | Pancreas | 0.705882 | 1 | 0.545455 |
| NOX4 AND GPRC5A | Pancreas | 0.705882 | 1 | 0.545455 |
| NOX4 AND PTPRH | Pancreas | 0.736842 | 0.875 | 0.636364 |
| TREM2 AND ADAM28 | Pancreas | 0.666667 | 0.857143 | 0.545455 |
| KCNE4 AND ADAM12 | Pancreas | 0.666667 | 0.615385 | 0.727273 |
| TM4SF1 AND SYT13 | Pancreas | 0.736842 | 0.875 | 0.636364 |
| KCNE4 AND GABRP | Pancreas | 0.695652 | 0.666667 | 0.727273 |
| OLR1 AND ITGA11 | Pancreas | 0.736842 | 0.875 | 0.636364 |
| SYT13 AND TSPAN4 | Pancreas | 0.761905 | 0.8 | 0.727273 |
| TNFSF13B AND PPAP2C | Pancreas | 0.705882 | 1 | 0.545455 |
| SYT13 AND PKD2 | Pancreas | 0.64 | 0.571429 | 0.727273 |
| KCNE4 AND TLR2 | Pancreas | 0.64 | 0.571429 | 0.727273 |
| KCNE4 AND GPR65 | Pancreas | 0.64 | 0.571429 | 0.727273 |
| GP2 AND OLR1 | Pancreas | 0.777778 | 1 | 0.636364 |
| GP2 AND EDNRA | Pancreas | 0.8 | 0.888889 | 0.727273 |
| GP2 AND ITGB2 | Pancreas | 0.705882 | 1 | 0.545455 |
| KCNE4 AND ITGA4 | Pancreas | 0.666667 | 0.615385 | 0.727273 |
| GP2 AND NTM | Pancreas | 0.777778 | 1 | 0.636364 |
| SYT13 AND GLIPR1 | Pancreas | 0.952381 | 1 | 0.909091 |
| KCNE4 AND SLC39A14 | Pancreas | 0.636364 | 0.636364 | 0.636364 |
| NOX4 AND CD300LF | Pancreas | 0.636364 | 0.636364 | 0.636364 |
| KCNE4 AND ATP1A1 | Pancreas | 0.636364 | 0.636364 | 0.636364 |
| KCNE4 AND PTPN2 | Pancreas | 0.666667 | 0.615385 | 0.727273 |
| GP2 AND LRRC32 | Pancreas | 0.705882 | 1 | 0.545455 |
| NOX4 AND VSIG1 | Pancreas | 0.7 | 0.777778 | 0.636364 |
| KCNE4 AND TMEM30B | Pancreas | 0.64 | 0.571429 | 0.727273 |
| TNFSF13B AND GJB1 | Pancreas | 0.705882 | 1 | 0.545455 |
| PDGFRB AND LITAF | Pancreas | 0.705882 | 1 | 0.545455 |
| SYT13 AND CXCR4 | Pancreas | 0.842105 | 1 | 0.727273 |
| TM4SF1 AND ITGA11 | Pancreas | 0.631579 | 0.75 | 0.545455 |
| NOX4 AND TREM1 | Pancreas | 0.64 | 0.571429 | 0.727273 |
| NOX4 AND TNFRSF21 | Pancreas | 0.631579 | 0.75 | 0.545455 |
| KCNE4 AND SLC1A1 | Pancreas | 0.727273 | 0.727273 | 0.727273 |
| TNFSF4 AND GPRC5A | Pancreas | 0.705882 | 1 | 0.545455 |
| GP2 AND AMIGO2 | Pancreas | 0.842105 | 1 | 0.727273 |
| GP2 AND ITGAM | Pancreas | 0.842105 | 1 | 0.727273 |
| TNFSF13B AND DUOX2 | Pancreas | 0.666667 | 0.857143 | 0.545455 |
| SYT13 AND FXYD5 | Pancreas | 0.842105 | 1 | 0.727273 |
| OLR1 AND DUOX2 | Pancreas | 0.705882 | 1 | 0.545455 |
| GP2 AND MSR1 | Pancreas | 0.8 | 0.888889 | 0.727273 |
| GJB1 AND CALHM2 | Pancreas | 0.705882 | 1 | 0.545455 |
| GP2 AND CLEC5A | Pancreas | 0.8 | 0.888889 | 0.727273 |
| GP2 AND ADAM12 | Pancreas | 0.736842 | 0.875 | 0.636364 |
| NOX4 AND SLCO2B1 | Pancreas | 0.7 | 0.777778 | 0.636364 |
| NOX4 AND PTPN2 | Pancreas | 0.761905 | 0.8 | 0.727273 |
| OLR1 AND SLC15A1 | Pancreas | 0.705882 | 1 | 0.545455 |
| SYT13 AND CALCRL | Pancreas | 0.64 | 0.571429 | 0.727273 |
| TREM2 AND SLC28A3 | Pancreas | 0.666667 | 0.857143 | 0.545455 |
| SYT13 AND ITGAM | Pancreas | 0.846154 | 0.733333 | 1 |

| Antigen Pair Logic | Cancer (short name) | F1 | Precision | Recall |
|---|---|---|---|---|
| PTPRZ1 AND CD79B | Astrocytoma | 0.703297 | 0.711111 | 0.695652 |
| PTPRZ1 AND PTK7 | Astrocytoma | 0.703297 | 0.711111 | 0.695652 |
| PTPRZ1 AND TNFRSF17 | Astrocytoma | 0.702128 | 0.6875 | 0.717391 |
| NCAM1 AND SLC3A2 | Astrocytoma | 0.702128 | 0.6875 | 0.717391 |
| MMP16 AND ITGAV | Astrocytoma | 0.701299 | 0.870968 | 0.586957 |
| ADCYAP1R1 AND CLDN1 | Astrocytoma | 0.701031 | 0.666667 | 0.73913 |
| NRCAM AND CD38 | Astrocytoma | 0.698113 | 0.616667 | 0.804348 |
| PTPRZ1 AND SSTR1 | Astrocytoma | 0.698113 | 0.616667 | 0.804348 |
| PTPRZ1 AND CD37 | Astrocytoma | 0.695652 | 0.695652 | 0.695652 |
| PTPRZ1 AND CA9 | Astrocytoma | 0.694737 | 0.673469 | 0.717391 |
| NCAM1 AND ATP13A4 | Astrocytoma | 0.692308 | 0.84375 | 0.586957 |
| BMPR1B AND TLR4 | Astrocytoma | 0.691358 | 0.8 | 0.608696 |
| MMP16 AND SLC39A6 | Astrocytoma | 0.690476 | 0.763158 | 0.630435 |
| NRCAM AND FAP | Astrocytoma | 0.690476 | 0.763158 | 0.630435 |
| PTPRZ1 AND SLC7A5 | Astrocytoma | 0.688172 | 0.680851 | 0.695652 |
| NCAM1 AND BMPR1A | Astrocytoma | 0.688172 | 0.680851 | 0.695652 |
| NCAM1 AND SLC16A2 | Astrocytoma | 0.688172 | 0.680851 | 0.695652 |
| PTPRZ1 AND SSTR4 | Astrocytoma | 0.688172 | 0.680851 | 0.695652 |
| PTPRZ1 AND ULBP1 | Astrocytoma | 0.6875 | 0.66 | 0.717391 |
| PTPRZ1 AND FCRL1 | Astrocytoma | 0.6875 | 0.66 | 0.717391 |
| PTPRZ1 AND CD19 | Astrocytoma | 0.685714 | 0.610169 | 0.782609 |
| CALCRL AND BMPR1B | Astrocytoma | 0.682927 | 0.777778 | 0.608696 |
| MMP16 AND EDNRB | Astrocytoma | 0.682927 | 0.777778 | 0.608696 |
| NCAM1 AND SRR | Astrocytoma | 0.680851 | 0.666667 | 0.695652 |
| PTPRZ1 AND TNFSF11 | Astrocytoma | 0.680412 | 0.647059 | 0.717391 |
| PTPRZ1 AND GPA33 | Astrocytoma | 0.680412 | 0.647059 | 0.717391 |
| PTPRZ1 AND ABCB5 | Astrocytoma | 0.680412 | 0.647059 | 0.717391 |
| PTPRZ1 AND MUC4 | Astrocytoma | 0.680412 | 0.647059 | 0.717391 |
| PTPRZ1 AND CR2 | Astrocytoma | 0.68 | 0.62963 | 0.73913 |
| NRCAM AND RAET1E | Astrocytoma | 0.678899 | 0.587302 | 0.804348 |
| KCNN3 AND CLDN1 | Astrocytoma | 0.690476 | 0.763158 | 0.630435 |
| KCNN3 AND CD33 | Astrocytoma | 0.691358 | 0.8 | 0.608696 |
| ADCYAP1R1 AND FAP | Astrocytoma | 0.674699 | 0.756757 | 0.608696 |
| PTPRZ1 AND CD180 | Astrocytoma | 0.674699 | 0.756757 | 0.608696 |
| ADAM12 AND SDC1 | Breast | 0.875 | 1 | 0.777778 |
| ADAM12 AND MUC1 | Breast | 0.857143 | 0.954545 | 0.777778 |
| ADAM12 AND CLDN7 | Breast | 0.833333 | 0.952381 | 0.740741 |
| FAP AND CD300LF | Breast | 0.8 | 0.926829 | 0.703704 |
| FAP AND CXCR4 | Breast | 0.826087 | 1 | 0.703704 |
| FAP AND SLC16A3 | Breast | 0.821053 | 0.95122 | 0.722222 |
| FAP AND IL17RB | Breast | 0.821053 | 0.95122 | 0.722222 |
| FAP AND SLC52A2 | Breast | 0.863158 | 1 | 0.759259 |
| FAP AND CNNM4 | Breast | 0.813187 | 1 | 0.685185 |
| FAP AND KIAA1324 | Breast | 0.786517 | 1 | 0.648148 |
| FAP AND OR51B2 | Breast | 0.783505 | 0.883721 | 0.703704 |
| FAP AND UNC5B | Breast | 0.772727 | 1 | 0.62963 |
| FAP AND MFSD10 | Breast | 0.758621 | 1 | 0.611111 |
| ADAM12 AND ERBB3 | Breast | 0.758621 | 1 | 0.611111 |
| SLC5A6 AND FAP | Breast | 0.758621 | 1 | 0.611111 |
| FAP AND CACFD1 | Breast | 0.886598 | 1 | 0.796296 |
| FAP AND VMP1 | Breast | 0.795699 | 0.948718 | 0.685185 |
| FAP AND LPAR2 | Breast | 0.758621 | 1 | 0.611111 |
| FAP AND ADAM8 | Breast | 0.782609 | 0.947368 | 0.666667 |
| FGG AND ERBB3 | Liver | 0.833333 | 0.833333 | 0.833333 |
| FGG AND EPHB2 | Liver | 1 | 1 | 1 |
| FGG AND CD34 | Liver | 0.8 | 1 | 0.666667 |
| ASGR1 AND CD34 | Liver | 0.909091 | 1 | 0.833333 |
| ASGR1 AND ERBB3 | Liver | 0.769231 | 0.714286 | 0.833333 |
| FGG AND IL3RA | Liver | 0.769231 | 0.714286 | 0.833333 |
| FGG AND LGR5 | Liver | 0.833333 | 0.833333 | 0.833333 |
| ASGR1 AND EPHB2 | Liver | 0.909091 | 1 | 0.833333 |
| HPN AND ERBB3 | Liver | 0.833333 | 0.833333 | 0.833333 |
| HPN AND CD34 | Liver | 0.909091 | 1 | 0.833333 |
| FGG AND VTCN1 | Liver | 0.8 | 1 | 0.666667 |
| ABCC6 AND CD34 | Liver | 0.8 | 1 | 0.666667 |
| HPN AND EPHB2 | Liver | 1 | 1 | 1 |
| TFR2 AND EPHB2 | Liver | 0.909091 | 1 | 0.833333 |
| ASGR1 AND LGR5 | Liver | 0.769231 | 0.714286 | 0.833333 |
| ABCB4 AND CD34 | Liver | 0.8 | 1 | 0.666667 |
| SLC27A5 AND EPHB2 | Liver | 0.909091 | 1 | 0.833333 |
| HPN AND IL3RA | Liver | 0.833333 | 0.833333 | 0.833333 |
| HPN AND LGR5 | Liver | 0.833333 | 0.833333 | 0.833333 |
| SLC27A5 AND ERBB3 | Liver | 0.769231 | 0.714286 | 0.833333 |
| SLC27A5 AND CD34 | Liver | 0.8 | 1 | 0.666667 |
| FGG AND SSTR5 | Liver | 0.727273 | 0.8 | 0.666667 |
| FGG AND SSTR3 | Liver | 0.769231 | 0.714286 | 0.833333 |
| HPN AND ULBP1 | Liver | 0.769231 | 0.714286 | 0.833333 |

FIG. 8 (Cont.)

| Antigen Pair Logic | Cancer (short name) | F1 | Precision | Recall |
|---|---|---|---|---|
| NOX4 AND OLR1 | Pancreas | 0.625 | 1 | 0.454545 |
| CLEC5A AND SYT13 | Pancreas | 0.625 | 1 | 0.454545 |
| TREM2 AND DSG2 | Pancreas | 0.625 | 1 | 0.454545 |
| TM4SF1 AND NALCN | Pancreas | 0.625 | 1 | 0.454545 |
| CLEC5A AND GJB1 | Pancreas | 0.625 | 1 | 0.454545 |
| NOX4 AND TREM2 | Pancreas | 0.625 | 1 | 0.454545 |
| TREM2 AND GJB2 | Pancreas | 0.625 | 1 | 0.454545 |
| NOX4 AND SLC16A3 | Pancreas | 0.625 | 1 | 0.454545 |
| SYT13 AND TYROBP | Pancreas | 0.625 | 1 | 0.454545 |
| KCNE4 AND GJB1 | Pancreas | 0.625 | 1 | 0.454545 |
| NOX4 AND HLA-C | Pancreas | 0.625 | 1 | 0.454545 |
| KCNE4 AND TREM2 | Pancreas | 0.625 | 1 | 0.454545 |
| GP2 AND CALHM2 | Pancreas | 0.666667 | 0.615385 | 0.727273 |
| TNFSF13B AND RAMP1 | Pancreas | 0.777778 | 1 | 0.636364 |
| CLEC5A AND TNFRSF21 | Pancreas | 0.625 | 1 | 0.454545 |
| GP2 AND CD53 | Pancreas | 0.777778 | 1 | 0.636364 |
| TNFSF13B AND DSG2 | Pancreas | 0.705882 | 1 | 0.545455 |
| NOX4 AND SYT13 | Pancreas | 0.62069 | 0.5 | 0.818182 |
| NOX4 AND SLAMF6 | Pancreas | 0.62069 | 0.5 | 0.818182 |
| CDH6 AND ATRAID | Renal | 0.857143 | 1 | 0.75 |
| SLC3A1 AND SIRPA | Renal | 0.857143 | 1 | 0.75 |
| SLC3A1 AND TSPAN4 | Renal | 0.857143 | 1 | 0.75 |
| CDH6 AND HLA-C | Renal | 0.857143 | 1 | 0.75 |
| CDH6 AND JTB | Renal | 0.857143 | 1 | 0.75 |
| CDH6 AND S100A10 | Renal | 0.857143 | 1 | 0.75 |
| CDH6 AND HLA-B | Renal | 0.857143 | 1 | 0.75 |
| HEPH AND SLC39A10 | Colon | 1 | 1 | 1 |
| MEP1A AND AMIGO2 | Colon | 0.909091 | 0.833333 | 1 |
| ATP10B AND AMIGO2 | Colon | 0.909091 | 0.833333 | 1 |
| GPR160 AND EVA1A | Colon | 0.888889 | 1 | 0.8 |
| GPR160 AND EDNRA | Colon | 0.888889 | 1 | 0.8 |
| GPR160 AND PCDH17 | Colon | 0.888889 | 1 | 0.8 |
| GPR160 AND LDLRAD3 | Colon | 0.888889 | 1 | 0.8 |
| GPR160 AND CDH3 | Colon | 0.888889 | 1 | 0.8 |
| HEPH AND EVA1A | Colon | 0.888889 | 1 | 0.8 |
| GPR160 AND GJA4 | Colon | 0.888889 | 1 | 0.8 |
| PMEPA1 AND LY75 | Colon | 0.888889 | 1 | 0.8 |
| HEPH AND IL1RAP | Colon | 0.888889 | 1 | 0.8 |
| PMEPA1 AND GPR160 | Colon | 0.888889 | 1 | 0.8 |
| PMEPA1 AND PON2 | Colon | 0.888889 | 1 | 0.8 |
| GPR160 AND PODXL | Colon | 0.888889 | 1 | 0.8 |
| GPR160 AND TACSTD2 | Colon | 0.888889 | 1 | 0.8 |
| MEP1A AND SLC39A10 | Colon | 1 | 1 | 1 |
| HEPH AND TACSTD2 | Colon | 1 | 1 | 1 |
| PMEPA1 AND HEPH | Colon | 0.888889 | 1 | 0.8 |
| PMEPA1 AND IFITM1 | Colon | 0.888889 | 1 | 0.8 |
| GPR160 AND PDPN | Colon | 0.888889 | 1 | 0.8 |
| PMEPA1 AND SPINT1 | Colon | 0.888889 | 1 | 0.8 |
| ATP10B AND SLC39A10 | Colon | 1 | 1 | 1 |
| GPR160 AND EDAR | Colon | 0.888889 | 1 | 0.8 |
| HEPH AND EDAR | Colon | 0.888889 | 1 | 0.8 |
| PMEPA1 AND ATP1B1 | Colon | 0.888889 | 1 | 0.8 |
| SLC5A1 AND CD81 | Colon | 0.888889 | 1 | 0.8 |
| PMEPA1 AND ATP6AP2 | Colon | 0.888889 | 1 | 0.8 |
| PMEPA1 AND GPRC5A | Colon | 0.888889 | 1 | 0.8 |
| PPAP2C AND IFITM1 | Colon | 0.888889 | 1 | 0.8 |
| PMEPA1 AND IFNGR2 | Colon | 0.888889 | 1 | 0.8 |
| AMIGO2 AND PSENEN | Colon | 0.888889 | 1 | 0.8 |
| IHH AND SLC39A10 | Colon | 0.888889 | 1 | 0.8 |
| IYD AND SLC39A10 | Colon | 0.909091 | 0.833333 | 1 |
| HEPH AND APCDD1 | Colon | 0.8 | 0.8 | 0.8 |
| LSR AND AMIGO2 | Colon | 0.8 | 0.8 | 0.8 |
| AMIGO2 AND IYD | Colon | 0.8 | 0.8 | 0.8 |
| AMIGO2 AND TM4SF5 | Colon | 0.8 | 0.8 | 0.8 |
| GPM6B AND BMP2 | Ependymoma | 1 | 1 | 1 |
| GPM6B AND WLS | Ependymoma | 1 | 1 | 1 |
| SLC52A2 AND TMEM123 | Esophagus | 0.782609 | 1 | 0.642857 |
| PTPRZ1 AND OR1A1 | Glioblastoma | 0.909091 | 0.9375 | 0.882353 |
| PTPRZ1 AND SIGLEC10 | Glioblastoma | 0.866667 | 1 | 0.764706 |
| PTPRZ1 AND ADAM12 | Glioblastoma | 0.866667 | 1 | 0.764706 |
| PTPRZ1 AND SLC4A2 | Glioblastoma | 0.9375 | 1 | 0.882353 |
| PTPRZ1 AND SIRPG | Glioblastoma | 0.9375 | 1 | 0.882353 |
| NRCAM AND SLC4A2 | Glioblastoma | 0.875 | 0.933333 | 0.823529 |
| PTPRZ1 AND CD84 | Glioblastoma | 0.866667 | 1 | 0.764706 |
| PTPRZ1 AND ABCA1 | Glioblastoma | 0.875 | 0.933333 | 0.823529 |
| NRCAM AND BRCA1 | Glioblastoma | 0.903226 | 1 | 0.823529 |
| PTPRZ1 AND KCNK15 | Glioblastoma | 0.903226 | 1 | 0.823529 |

| Antigen Pair Logic | Cancer (short name) | F1 | Precision | Recall |
|---|---|---|---|---|
| HPN AND VTCN1 | Liver | 0.8 | 1 | 0.666667 |
| ABCB4 AND ERBB3 | Liver | 0.909091 | 1 | 0.833333 |
| FGG AND CLDN9 | Liver | 0.857143 | 0.75 | 1 |
| FGG AND ULBP1 | Liver | 0.714286 | 0.625 | 0.833333 |
| SLC27A5 AND LGR5 | Liver | 0.769231 | 0.714286 | 0.833333 |
| AQP9 AND ERBB3 | Liver | 0.769231 | 0.714286 | 0.833333 |
| FGG AND ABCB5 | Liver | 0.714286 | 0.625 | 0.833333 |
| SLC27A5 AND IL3RA | Liver | 0.714286 | 0.625 | 0.833333 |
| FGG AND ITGB6 | Liver | 0.8 | 0.666667 | 1 |
| FGG AND GPA33 | Liver | 0.8 | 0.666667 | 1 |
| FGG AND ULBP2 | Liver | 0.8 | 0.666667 | 1 |
| ASGR1 AND VTCN1 | Liver | 0.8 | 1 | 0.666667 |
| KCNE4 AND CLDN7 | Pancreas | 0.727273 | 0.727273 | 0.727273 |
| KCNE4 AND STEAP1 | Pancreas | 0.736842 | 0.875 | 0.636364 |
| FAP AND CXCR4 | Pancreas | 0.777778 | 1 | 0.636364 |
| FAP AND DSG2 | Pancreas | 0.777778 | 1 | 0.636364 |
| FAP AND SYT13 | Pancreas | 0.842105 | 1 | 0.727273 |
| TNFSF4 AND EPCAM | Pancreas | 0.777778 | 1 | 0.636364 |
| STEAP1 AND CXCR4 | Pancreas | 0.777778 | 1 | 0.636364 |
| FAP AND TNFRSF21 | Pancreas | 0.777778 | 1 | 0.636364 |
| FAP AND TSPAN1 | Pancreas | 0.705882 | 1 | 0.545455 |
| FAP AND ADAM28 | Pancreas | 0.705882 | 1 | 0.545455 |
| TNFSF11 AND TM4SF1 | Pancreas | 0.666667 | 0.857143 | 0.545455 |
| FAP AND CD53 | Pancreas | 0.777778 | 1 | 0.636364 |
| GP2 AND GPNMB | Pancreas | 0.777778 | 1 | 0.636364 |
| FAP AND ILDR1 | Pancreas | 0.777778 | 1 | 0.636364 |
| EPHA3 AND TM4SF1 | Pancreas | 0.705882 | 1 | 0.545455 |
| FAP AND TM4SF1 | Pancreas | 0.842105 | 1 | 0.727273 |
| NOX4 AND ITGB6 | Pancreas | 0.705882 | 1 | 0.545455 |
| FAP AND FXYD3 | Pancreas | 0.705882 | 1 | 0.545455 |
| FAP AND ATP1B1 | Pancreas | 0.777778 | 1 | 0.636364 |
| FAP AND PTPN2 | Pancreas | 0.777778 | 1 | 0.636364 |
| FAP AND TSPAN13 | Pancreas | 0.777778 | 1 | 0.636364 |
| FAP AND UGT8 | Pancreas | 0.777778 | 1 | 0.636364 |
| ADAM12 AND ITGB6 | Pancreas | 0.705882 | 1 | 0.545455 |
| FAP AND CD300LF | Pancreas | 0.777778 | 1 | 0.636364 |
| FAP AND NPC1L1 | Pancreas | 0.842105 | 1 | 0.727273 |
| FAP AND SLC44A3 | Pancreas | 0.842105 | 1 | 0.727273 |
| CLDN2 AND OLR1 | Pancreas | 0.8 | 0.888889 | 0.727273 |
| FAP AND LSR | Pancreas | 0.777778 | 1 | 0.636364 |
| FAP AND SLC6A14 | Pancreas | 0.705882 | 1 | 0.545455 |
| KCNE4 AND STEAP2 | Pancreas | 0.636364 | 0.636364 | 0.636364 |
| KCNE4 AND CLDN2 | Pancreas | 0.636364 | 0.636364 | 0.636364 |
| FAP AND IL2RG | Pancreas | 0.842105 | 1 | 0.727273 |
| FAP AND GPRC5A | Pancreas | 0.777778 | 1 | 0.636364 |
| NOX4 AND FCRL5 | Pancreas | 0.692308 | 0.6 | 0.818182 |
| FAP AND TNFSF13B | Pancreas | 0.777778 | 1 | 0.636364 |
| FAP AND F11R | Pancreas | 0.777778 | 1 | 0.636364 |
| FAP AND CD80 | Pancreas | 0.777778 | 1 | 0.636364 |
| FAP AND OR1A2 | Pancreas | 0.842105 | 1 | 0.727273 |
| FAP AND ST14 | Pancreas | 0.777778 | 1 | 0.636364 |
| FAP AND CRB3 | Pancreas | 0.777778 | 1 | 0.636364 |
| FAP AND TACSTD2 | Pancreas | 0.842105 | 1 | 0.727273 |
| FAP AND GPR160 | Pancreas | 0.777778 | 1 | 0.636364 |
| FAP AND CDH1 | Pancreas | 0.777778 | 1 | 0.636364 |
| FAP AND DSC2 | Pancreas | 0.705882 | 1 | 0.545455 |
| FAP AND C1orf210 | Pancreas | 0.777778 | 1 | 0.636364 |
| TNFSF4 AND CLDN7 | Pancreas | 0.736842 | 0.875 | 0.636364 |
| KCNE4 AND ITGB6 | Pancreas | 0.625 | 1 | 0.454545 |
| FAP AND LITAF | Pancreas | 0.625 | 1 | 0.454545 |
| KCNE4 AND EPCAM | Pancreas | 0.625 | 1 | 0.454545 |
| FAP AND VNN2 | Pancreas | 0.842105 | 1 | 0.727273 |
| FAP AND TAS2R16 | Pancreas | 0.777778 | 1 | 0.636364 |
| FAP AND FPR1 | Pancreas | 0.842105 | 1 | 0.727273 |
| FAP AND PCDHGA10 | Pancreas | 0.842105 | 1 | 0.727273 |
| FAP AND SPINT1 | Pancreas | 0.842105 | 1 | 0.727273 |
| FAP AND IL1R2 | Pancreas | 0.842105 | 1 | 0.727273 |
| FAP AND TREM2 | Pancreas | 0.777778 | 1 | 0.636364 |
| CDH6 AND TNFRSF13C | Renal | 0.857143 | 1 | 0.75 |
| CDH6 AND SLAMF7 | Renal | 0.857143 | 1 | 0.75 |
| CDH6 AND ABCB5 | Renal | 0.857143 | 1 | 0.75 |
| SLC3A1 AND CD276 | Renal | 0.818182 | 0.9 | 0.75 |
| CDH6 AND CD70 | Renal | 0.857143 | 1 | 0.75 |
| CDH6 AND CXCR5 | Renal | 0.857143 | 1 | 0.75 |
| CDH6 AND ENPP3 | Renal | 0.8 | 1 | 0.666667 |
| CDH6 AND CD52 | Renal | 0.857143 | 1 | 0.75 |
| CDH6 AND ERBB3 | Renal | 0.8 | 1 | 0.666667 |

FIG. 8 (Cont.)

| Antigen Pair Logic | Cancer (short name) | F1 | Precision | Recall |
|---|---|---|---|---|
| NRCAM AND CYBA | Glioblastoma | 0.9375 | 1 | 0.882353 |
| PTPRZ1 AND SLC2A5 | Glioblastoma | 0.866667 | 1 | 0.764706 |
| PTPRZ1 AND NRCAM | Glioblastoma | 0.909091 | 0.9375 | 0.882353 |
| PTPRZ1 AND ATP12A | Glioblastoma | 0.866667 | 1 | 0.764706 |
| NRCAM AND KCNK15 | Glioblastoma | 0.857143 | 0.833333 | 0.882353 |
| PTPRZ1 AND GPR65 | Glioblastoma | 0.83871 | 0.928571 | 0.764706 |
| PTPRZ1 AND CDH6 | Glioblastoma | 0.866667 | 1 | 0.764706 |
| PTPRZ1 AND MR1 | Glioblastoma | 0.866667 | 1 | 0.764706 |
| NRCAM AND SLC22A4 | Glioblastoma | 0.882353 | 0.882353 | 0.882353 |
| PTPRZ1 AND MMP16 | Glioblastoma | 0.875 | 0.933333 | 0.823529 |
| PTPRZ1 AND CLEC4A | Glioblastoma | 0.9375 | 1 | 0.882353 |
| PTPRZ1 AND CD99 | Glioblastoma | 0.9375 | 1 | 0.882353 |
| PTPRZ1 AND FCGRT | Glioblastoma | 0.866667 | 1 | 0.764706 |
| NRCAM AND VANGL2 | Glioblastoma | 0.875 | 0.933333 | 0.823529 |
| NRCAM AND PCDH18 | Glioblastoma | 0.866667 | 1 | 0.764706 |
| PTPRZ1 AND GJC1 | Glioblastoma | 0.827586 | 1 | 0.705882 |
| PTPRZ1 AND ATP13A1 | Glioblastoma | 0.827586 | 1 | 0.705882 |
| PTPRZ1 AND DDR2 | Glioblastoma | 0.827586 | 1 | 0.705882 |
| PTPRZ1 AND C5AR1 | Glioblastoma | 0.827586 | 1 | 0.705882 |
| PTPRZ1 AND ABCC3 | Glioblastoma | 0.827586 | 1 | 0.705882 |
| NRCAM AND CD99 | Glioblastoma | 0.827586 | 1 | 0.705882 |
| NRCAM AND PSENEN | Glioblastoma | 0.827586 | 1 | 0.705882 |
| PTPRZ1 AND ITGB8 | Glioblastoma | 0.827586 | 1 | 0.705882 |
| NRCAM AND AGTRAP | Glioblastoma | 0.827586 | 1 | 0.705882 |
| NRCAM AND EMP1 | Glioblastoma | 0.827586 | 1 | 0.705882 |
| PTPRZ1 AND CD163L1 | Glioblastoma | 0.827586 | 1 | 0.705882 |
| PTPRZ1 AND TMPRSS5 | Glioblastoma | 0.827586 | 1 | 0.705882 |
| PTPRZ1 AND TLR7 | Glioblastoma | 0.827586 | 1 | 0.705882 |
| PTPRZ1 AND F2RL2 | Glioblastoma | 0.827586 | 1 | 0.705882 |
| PTPRZ1 AND CXCR4 | Glioblastoma | 0.827586 | 1 | 0.705882 |
| NRCAM AND ADAM12 | Glioblastoma | 0.827586 | 1 | 0.705882 |
| NRCAM AND CTNS | Glioblastoma | 0.9375 | 1 | 0.882353 |
| NRCAM AND SLC11A1 | Glioblastoma | 0.827586 | 1 | 0.705882 |
| NRCAM AND BTN3A2 | Glioblastoma | 0.866667 | 1 | 0.764706 |
| NRCAM AND BMPR1A | Glioblastoma | 0.827586 | 1 | 0.705882 |
| PTPRZ1 AND OR51B6 | Glioblastoma | 0.903226 | 1 | 0.823529 |
| NLGN4X AND BRCA1 | Glioblastoma | 0.83871 | 0.928571 | 0.764706 |
| PTPRZ1 AND F2RL1 | Glioblastoma | 0.866667 | 1 | 0.764706 |
| PTPRZ1 AND SORT1 | Glioblastoma | 0.903226 | 1 | 0.823529 |
| NRCAM AND LMAN2 | Glioblastoma | 0.83871 | 0.928571 | 0.764706 |
| PTPRZ1 AND TLR3 | Glioblastoma | 0.827586 | 1 | 0.705882 |
| PTPRZ1 AND SLC6A8 | Glioblastoma | 0.827586 | 1 | 0.705882 |
| PTPRZ1 AND ITGB2 | Glioblastoma | 0.866667 | 1 | 0.764706 |
| PTPRZ1 AND ENTPD1 | Glioblastoma | 0.903226 | 1 | 0.823529 |
| PTPRZ1 AND EDNRA | Glioblastoma | 0.827586 | 1 | 0.705882 |
| PTPRZ1 AND SLC16A4 | Glioblastoma | 0.866667 | 1 | 0.764706 |
| NRCAM AND OR51B6 | Glioblastoma | 0.903226 | 1 | 0.823529 |
| PTPRZ1 AND TNFRSF19 | Glioblastoma | 0.866667 | 1 | 0.764706 |
| NRCAM AND ANO6 | Glioblastoma | 0.827586 | 1 | 0.705882 |
| NRCAM AND FAM57A | Glioblastoma | 0.827586 | 1 | 0.705882 |
| PTPRZ1 AND HRH1 | Glioblastoma | 0.827586 | 1 | 0.705882 |
| GPM6A AND SLC7A7 | Glioblastoma | 0.882353 | 0.882353 | 0.882353 |
| NRCAM AND SIGLEC10 | Glioblastoma | 0.83871 | 0.928571 | 0.764706 |
| NRCAM AND SLC16A4 | Glioblastoma | 0.827586 | 1 | 0.705882 |
| NRCAM AND CXCR4 | Glioblastoma | 0.827586 | 1 | 0.705882 |
| GPM6B AND TSPAN6 | Glioma | 0.962406 | 1 | 0.927536 |
| GPM6A AND TSPAN6 | Glioma | 0.970588 | 0.985075 | 0.956522 |
| GPM6B AND PLGRKT | Glioma | 0.970149 | 1 | 0.942029 |
| GPM6B AND ABCA1 | Glioma | 0.94964 | 0.942857 | 0.956522 |
| PTPRZ1 AND JAM2 | Glioma | 0.985294 | 1 | 0.971014 |
| GPM6A AND SLC40A1 | Glioma | 0.970588 | 0.985075 | 0.956522 |
| PTPRZ1 AND NRCAM | Glioma | 0.946565 | 1 | 0.898551 |
| GPM6A AND HLA-B | Glioma | 0.94964 | 0.942857 | 0.956522 |
| GPM6B AND ATP13A1 | Glioma | 0.954545 | 1 | 0.913043 |
| GPM6A AND ABCA1 | Glioma | 0.963504 | 0.970588 | 0.956522 |
| GPM6B AND ATRAID | Glioma | 0.978102 | 0.985294 | 0.971014 |
| GPM6A AND PLGRKT | Glioma | 0.970149 | 1 | 0.942029 |
| GPM6B AND JTB | Glioma | 0.962406 | 1 | 0.927536 |
| GPM6A AND JTB | Glioma | 0.962406 | 1 | 0.927536 |
| PTPRZ1 AND HLA-B | Glioma | 0.992701 | 1 | 0.985507 |
| PTPRZ1 AND BFAR | Glioma | 0.992701 | 1 | 0.985507 |
| PTPRZ1 AND XPR1 | Glioma | 0.970149 | 1 | 0.942029 |
| GPM6A AND ATRAID | Glioma | 0.985294 | 1 | 0.971014 |
| PTPRZ1 AND ABCA1 | Glioma | 0.985294 | 1 | 0.971014 |
| PTPRZ1 AND SLC40A1 | Glioma | 0.977778 | 1 | 0.956522 |
| PTPRZ1 AND TSPAN6 | Glioma | 0.962406 | 1 | 0.927536 |
| GPM6B AND XPR1 | Glioma | 0.970149 | 1 | 0.942029 |
| CDH6 AND FOLR1 | Renal | 0.857143 | 1 | 0.75 |
| SLC3A1 AND MET | Renal | 0.8 | 1 | 0.666667 |
| CDH6 AND ULBP1 | Renal | 0.857143 | 1 | 0.75 |
| CDH6 AND CD37 | Renal | 0.857143 | 1 | 0.75 |
| CDH6 AND CD19 | Renal | 0.857143 | 1 | 0.75 |
| CDH6 AND VCAM1 | Renal | 0.8 | 1 | 0.666667 |
| CDH6 AND EPCAM | Renal | 0.8 | 1 | 0.666667 |
| CDH6 AND SLC34A2 | Renal | 0.857143 | 1 | 0.75 |
| CDH6 AND MET | Renal | 0.857143 | 1 | 0.75 |
| CDH6 AND GPNMB | Renal | 0.857143 | 1 | 0.75 |
| VCAM1 AND SYT13 | Renal | 0.857143 | 1 | 0.75 |
| SLC3A1 AND VCAM1 | Renal | 0.761905 | 0.888889 | 0.666667 |
| KCNJ16 AND VCAM1 | Renal | 0.761905 | 0.888889 | 0.666667 |
| VCAM1 AND OR10H3 | Renal | 0.761905 | 0.888889 | 0.666667 |
| DPEP1 AND CD81 | Colon | 1 | 1 | 1 |
| DPEP1 AND IFITM1 | Colon | 1 | 1 | 1 |
| DPEP1 AND AMIGO2 | Colon | 1 | 1 | 1 |
| HEPH AND CLDN1 | Colon | 1 | 1 | 1 |
| GUCY2C AND AMIGO2 | Colon | 0.909091 | 0.833333 | 1 |
| MUC13 AND AMIGO2 | Colon | 0.909091 | 0.833333 | 1 |
| DPEP1 AND TMEM123 | Colon | 1 | 1 | 1 |
| CEACAM5 AND SLC39A10 | Colon | 1 | 1 | 1 |
| CLDN2 AND AMIGO2 | Colon | 0.888889 | 1 | 0.8 |
| CLDN2 AND ARL6IP5 | Colon | 0.888889 | 1 | 0.8 |
| GPR160 AND FAP | Colon | 0.888889 | 1 | 0.8 |
| PMEPA1 AND CEACAM6 | Colon | 0.888889 | 1 | 0.8 |
| DPEP1 AND SMAGP | Colon | 0.888889 | 1 | 0.8 |
| HEPH AND SLC7A5 | Colon | 0.888889 | 1 | 0.8 |
| GPR160 AND THY1 | Colon | 0.888889 | 1 | 0.8 |
| GPR160 AND SLC7A5 | Colon | 0.888889 | 1 | 0.8 |
| GPR160 AND CLDN1 | Colon | 0.888889 | 1 | 0.8 |
| DPEP1 AND SERINC5 | Colon | 0.888889 | 1 | 0.8 |
| GUCY2C AND SLC39A10 | Colon | 1 | 1 | 1 |
| GPA33 AND AMIGO2 | Colon | 0.909091 | 0.833333 | 1 |
| MUC13 AND SLC39A10 | Colon | 1 | 1 | 1 |
| HEPH AND THY1 | Colon | 1 | 1 | 1 |
| PRNP AND ABCB5 | Ependymoma | 1 | 1 | 1 |
| SSTR1 AND CD81 | Ependymoma | 1 | 1 | 1 |
| GPM6B AND CD38 | Ependymoma | 1 | 1 | 1 |
| PRNP AND ERBB2 | Ependymoma | 1 | 1 | 1 |
| PRNP AND CLDN2 | Ependymoma | 1 | 1 | 1 |
| PRNP AND VTCN1 | Ependymoma | 1 | 1 | 1 |
| PRNP AND RNF43 | Ependymoma | 1 | 1 | 1 |
| BCAP31 AND EPCAM | Esophagus | 0.692308 | 0.75 | 0.642857 |
| TM4SF5 AND MOK | Esophagus | 0.727273 | 1 | 0.571429 |
| GPRC5A AND MOK | Esophagus | 0.666667 | 1 | 0.5 |
| SLC52A2 AND ITGAV | Esophagus | 0.782609 | 1 | 0.642857 |
| CBX3 AND CDCP1 | Esophagus | 0.64 | 0.727273 | 0.571429 |
| CBX3 AND TACSTD2 | Esophagus | 0.727273 | 1 | 0.571429 |
| CBX3 AND PPAP2C | Esophagus | 0.666667 | 0.8 | 0.571429 |
| CBX3 AND CXADR | Esophagus | 0.64 | 0.727273 | 0.571429 |
| CBX3 AND SLC39A4 | Esophagus | 0.666667 | 0.8 | 0.571429 |
| CBX3 AND IL22RA1 | Esophagus | 0.666667 | 0.8 | 0.571429 |
| BCAP31 AND MUC13 | Esophagus | 0.64 | 0.727273 | 0.571429 |
| EPCAM AND RHBDF2 | Esophagus | 0.666667 | 1 | 0.5 |
| CBX3 AND EDNRA | Esophagus | 0.666667 | 0.8 | 0.571429 |
| CBX3 AND GPRC5A | Esophagus | 0.64 | 0.727273 | 0.571429 |
| SLC52A2 AND CLDN1 | Esophagus | 0.782609 | 1 | 0.642857 |
| PTPRH AND MOK | Esophagus | 0.636364 | 0.875 | 0.5 |
| SLC52A2 AND ULBP2 | Esophagus | 0.6 | 1 | 0.428571 |
| PTPRZ1 AND CD33 | Glioblastoma | 0.866667 | 1 | 0.764706 |
| PTPRZ1 AND CD180 | Glioblastoma | 0.866667 | 1 | 0.764706 |
| PTPRZ1 AND VCAM1 | Glioblastoma | 0.9375 | 1 | 0.882353 |
| PTPRZ1 AND CD70 | Glioblastoma | 0.909091 | 0.9375 | 0.882353 |
| PTPRZ1 AND SDC1 | Glioblastoma | 0.827586 | 1 | 0.705882 |
| PTPRZ1 AND IL13RA1 | Glioblastoma | 0.903226 | 1 | 0.823529 |
| PTPRZ1 AND ENG | Glioblastoma | 0.785714 | 1 | 0.647059 |
| PTPRZ1 AND NCAM1 | Glioblastoma | 0.909091 | 0.9375 | 0.882353 |
| NRCAM AND VCAM1 | Glioblastoma | 0.909091 | 0.9375 | 0.882353 |
| BMPR1B AND SIGLEC10 | Glioblastoma | 0.777778 | 0.736842 | 0.823529 |
| PTPRZ1 AND SLC39A6 | Glioblastoma | 0.9375 | 1 | 0.882353 |
| PTPRZ1 AND BMPR1B | Glioblastoma | 0.909091 | 0.9375 | 0.882353 |
| AQP4 AND EGFR | Glioblastoma | 0.758621 | 0.916667 | 0.647059 |
| NRCAM AND AXL | Glioblastoma | 0.882353 | 0.882353 | 0.882353 |
| PTPRZ1 AND KDR | Glioblastoma | 0.866667 | 1 | 0.764706 |
| NRCAM AND IL13RA1 | Glioblastoma | 0.789474 | 0.714286 | 0.882353 |
| NRCAM AND CD180 | Glioblastoma | 0.756757 | 0.7 | 0.823529 |

FIG. 8 (Cont.)

| Antigen Pair Logic | Cancer (short name) | F1 | Precision | Recall |
|---|---|---|---|---|
| PTPRZ1 AND CD46 | Glioma | 0.962406 | 1 | 0.927536 |
| PTPRZ1 AND PRCP | Glioma | 0.977778 | 1 | 0.956522 |
| PTPRZ1 AND SGCB | Glioma | 0.985294 | 1 | 0.971014 |
| NRCAM AND SLC3A2 | Glioma | 0.938462 | 1 | 0.884058 |
| GPM6B AND JAM2 | Glioma | 0.964029 | 0.957143 | 0.971014 |
| PTPRZ1 AND HLA-G | Glioma | 0.992701 | 1 | 0.985507 |
| PTPRZ1 AND ADAM9 | Glioma | 0.962406 | 1 | 0.927536 |
| GPM6B AND DIABLO | Glioma | 0.992701 | 1 | 0.985507 |
| PTPRZ1 AND PLGRKT | Glioma | 0.970149 | 1 | 0.942029 |
| NRCAM AND HLA-G | Glioma | 0.938462 | 1 | 0.884058 |
| PTPRZ1 AND TNFRSF21 | Glioma | 0.977778 | 1 | 0.956522 |
| GPM6B AND BFAR | Glioma | 0.951049 | 0.918919 | 0.985507 |
| PTPRZ1 AND CALCRL | Glioma | 0.962406 | 1 | 0.927536 |
| NRCAM AND IL10RB | Glioma | 0.938462 | 1 | 0.884058 |
| NRCAM AND HLA-C | Glioma | 0.930233 | 1 | 0.869565 |
| NRCAM AND CD81 | Glioma | 0.930233 | 1 | 0.869565 |
| VMP1 AND SGCD | Leiomyosarcoma | 0.727273 | 0.888889 | 0.615385 |
| DDR2 AND BRCA1 | Leiomyosarcoma | 0.666667 | 0.875 | 0.538462 |
| ADAM12 AND HTR2A | Liposarcoma | 0.765432 | 0.688889 | 0.861111 |
| ADAM12 AND CACNA1C | Liposarcoma | 0.738095 | 0.645833 | 0.861111 |
| ADAM12 AND STOML3 | Liposarcoma | 0.729412 | 0.632653 | 0.861111 |
| ADAM12 AND SLC38A5 | Liposarcoma | 0.729412 | 0.632653 | 0.861111 |
| ADAM12 AND EMP1 | Liposarcoma | 0.765432 | 0.688889 | 0.861111 |
| ADAM12 AND GABRR1 | Liposarcoma | 0.731707 | 0.652174 | 0.833333 |
| ADAM12 AND TNFRSF9 | Liposarcoma | 0.738095 | 0.645833 | 0.861111 |
| CNTNAP1 AND SLC2A10 | Liposarcoma | 0.779221 | 0.731707 | 0.833333 |
| ADAM12 AND OR2B2 | Liposarcoma | 0.72093 | 0.62 | 0.861111 |
| ADAM12 AND GP5 | Liposarcoma | 0.740741 | 0.666667 | 0.833333 |
| ADAM12 AND CORIN | Liposarcoma | 0.72093 | 0.62 | 0.861111 |
| ADAM12 AND SGCD | Liposarcoma | 0.729412 | 0.632653 | 0.861111 |
| ADAM12 AND GJB6 | Liposarcoma | 0.716049 | 0.644444 | 0.805556 |
| ADAM12 AND MC3R | Liposarcoma | 0.731707 | 0.652174 | 0.833333 |
| ADAM12 AND PCDHB4 | Liposarcoma | 0.712644 | 0.607843 | 0.861111 |
| ADAM12 AND S100A10 | Liposarcoma | 0.712644 | 0.607843 | 0.861111 |
| ADAM12 AND PCDHGC3 | Liposarcoma | 0.712644 | 0.607843 | 0.861111 |
| ADAM12 AND LAX1 | Liposarcoma | 0.712644 | 0.607843 | 0.861111 |
| ADAM12 AND CLEC5A | Liposarcoma | 0.712644 | 0.607843 | 0.861111 |
| ADAM12 AND TRPA1 | Liposarcoma | 0.712644 | 0.607843 | 0.861111 |
| ADAM12 AND MSR1 | Liposarcoma | 0.775 | 0.704545 | 0.861111 |
| ADAM12 AND OR10A3 | Liposarcoma | 0.731707 | 0.652174 | 0.833333 |
| ADAM12 AND UGT8 | Liposarcoma | 0.714286 | 0.625 | 0.833333 |
| ADAM12 AND CHRM1 | Liposarcoma | 0.746988 | 0.659574 | 0.861111 |
| ADAM12 AND PCDHGC5 | Liposarcoma | 0.746988 | 0.659574 | 0.861111 |
| ADAM12 AND CRTAM | Liposarcoma | 0.705882 | 0.612245 | 0.833333 |
| ADAM12 AND SLC5A12 | Liposarcoma | 0.746988 | 0.659574 | 0.861111 |
| ADAM12 AND PDCD1LG2 | Liposarcoma | 0.729412 | 0.632653 | 0.861111 |
| ADAM12 AND TAS1R2 | Liposarcoma | 0.729412 | 0.632653 | 0.861111 |
| ADAM12 AND FRRS1L | Liposarcoma | 0.729412 | 0.632653 | 0.861111 |
| ADAM12 AND SLC4A9 | Liposarcoma | 0.705882 | 0.612245 | 0.833333 |
| ADAM12 AND EMCN | Liposarcoma | 0.738095 | 0.645833 | 0.861111 |
| ADAM12 AND HRH4 | Liposarcoma | 0.707317 | 0.630435 | 0.805556 |
| ADAM12 AND TAAR1 | Liposarcoma | 0.729412 | 0.632653 | 0.861111 |
| ADAM12 AND KCNG3 | Liposarcoma | 0.731707 | 0.652174 | 0.833333 |
| ADAM12 AND TAS2R14 | Liposarcoma | 0.704545 | 0.596154 | 0.861111 |
| ADAM12 AND KISS1R | Liposarcoma | 0.704545 | 0.596154 | 0.861111 |
| ADAM12 AND MTDH | Liposarcoma | 0.704545 | 0.596154 | 0.861111 |
| ADAM12 AND GPR84 | Liposarcoma | 0.705882 | 0.612245 | 0.833333 |
| ADAM12 AND PILRA | Liposarcoma | 0.712644 | 0.607843 | 0.861111 |
| CNTNAP1 AND TYROBP | Liposarcoma | 0.732394 | 0.742857 | 0.722222 |
| ADAM12 AND VSIG1 | Liposarcoma | 0.704545 | 0.596154 | 0.861111 |
| ADAM12 AND FPR3 | Liposarcoma | 0.75 | 0.681818 | 0.833333 |
| ADAM12 AND CATSPER1 | Liposarcoma | 0.729412 | 0.632653 | 0.861111 |
| ADAM12 AND PCDH7 | Liposarcoma | 0.739726 | 0.72973 | 0.75 |
| ADAM12 AND PCDHB10 | Liposarcoma | 0.696629 | 0.584906 | 0.861111 |
| ADAM12 AND C5AR1 | Liposarcoma | 0.696629 | 0.584906 | 0.861111 |
| ADAM12 AND KCNH8 | Liposarcoma | 0.698795 | 0.617021 | 0.805556 |
| ADAM12 AND TAS2R8 | Liposarcoma | 0.75 | 0.681818 | 0.833333 |
| ADAM12 AND VMP1 | Liposarcoma | 0.692308 | 0.642857 | 0.75 |
| ADAM12 AND OR5P2 | Liposarcoma | 0.691358 | 0.622222 | 0.777778 |
| ADAM12 AND CHIC2 | Liposarcoma | 0.688889 | 0.574074 | 0.861111 |
| ADAM12 AND GRIA2 | Liposarcoma | 0.75 | 0.681818 | 0.833333 |
| ADAM12 AND IFITM2 | Liposarcoma | 0.704545 | 0.596154 | 0.861111 |
| ADAM12 AND SLC23A1 | Liposarcoma | 0.729412 | 0.632653 | 0.861111 |
| ADAM12 AND CNTNAP1 | Liposarcoma | 0.732394 | 0.742857 | 0.722222 |
| CNTNAP1 AND IFNGR2 | Liposarcoma | 0.698413 | 0.814815 | 0.611111 |
| ADAM12 AND GYPE | Liposarcoma | 0.682353 | 0.591837 | 0.805556 |
| ADAM12 AND SLC6A14 | Liposarcoma | 0.682353 | 0.591837 | 0.805556 |

| Antigen Pair Logic | Cancer (short name) | F1 | Precision | Recall |
|---|---|---|---|---|
| PTPRZ1 AND AXL | Glioblastoma | 0.875 | 0.933333 | 0.823529 |
| NCAM1 AND SLC3A2 | Glioblastoma | 0.83871 | 0.928571 | 0.764706 |
| PTPRZ1 AND SLC7A5 | Glioblastoma | 0.758621 | 0.916667 | 0.647059 |
| NCAM1 AND TSPAN6 | Glioblastoma | 0.758621 | 0.916667 | 0.647059 |
| NRCAM AND MUC1 | Glioblastoma | 0.740741 | 1 | 0.588235 |
| NRCAM AND KDR | Glioblastoma | 0.736842 | 0.666667 | 0.823529 |
| NRCAM AND ENG | Glioblastoma | 0.714286 | 0.909091 | 0.588235 |
| PTPRZ1 AND P2RX5 | Glioblastoma | 0.714286 | 0.909091 | 0.588235 |
| NCAM1 AND WNT5A | Glioblastoma | 0.714286 | 0.909091 | 0.588235 |
| NRCAM AND EDNRB | Glioblastoma | 0.714286 | 0.6 | 0.882353 |
| AQP4 AND CD33 | Glioblastoma | 0.733333 | 0.846154 | 0.647059 |
| BMPR1B AND ADAM12 | Glioblastoma | 0.742857 | 0.722222 | 0.764706 |
| FZD3 AND VCAM1 | Glioblastoma | 0.727273 | 0.75 | 0.705882 |
| AQP4 AND CD180 | Glioblastoma | 0.709677 | 0.785714 | 0.647059 |
| BMPR1B AND SLC3A2 | Glioblastoma | 0.777778 | 0.736842 | 0.823529 |
| NRCAM AND ITGAV | Glioblastoma | 0.866667 | 1 | 0.764706 |
| PTPRZ1 AND CSPG4 | Glioblastoma | 0.692308 | 1 | 0.529412 |
| PTPRZ1 AND MUC1 | Glioblastoma | 0.692308 | 1 | 0.529412 |
| PTPRZ1 AND CA9 | Glioblastoma | 0.692308 | 1 | 0.529412 |
| NCAM1 AND SRR | Glioblastoma | 0.6875 | 0.733333 | 0.647059 |
| BMPR1B AND ABCA1 | Glioblastoma | 0.684211 | 0.619048 | 0.764706 |
| BMPR1B AND SLC11A1 | Glioblastoma | 0.785714 | 1 | 0.647059 |
| NRCAM AND GPNMB | Glioblastoma | 0.866667 | 1 | 0.764706 |
| NCAM1 AND VANGL2 | Glioblastoma | 0.666667 | 0.9 | 0.529412 |
| NLGN4X AND MUC1 | Glioblastoma | 0.666667 | 0.9 | 0.529412 |
| NRCAM AND CSPG4 | Glioblastoma | 0.666667 | 0.769231 | 0.588235 |
| GPM6B AND GPNMB | Glioblastoma | 0.666667 | 0.631579 | 0.705882 |
| NCAM1 AND FAM57A | Glioblastoma | 0.666667 | 0.9 | 0.529412 |
| SLC7A5 AND SLC11A1 | Glioblastoma | 0.666667 | 0.9 | 0.529412 |
| CSPG4 AND PON2 | Glioblastoma | 0.692308 | 1 | 0.529412 |
| NLGN4X AND ITGAV | Glioblastoma | 0.666667 | 0.769231 | 0.588235 |
| NCAM1 AND IGDCC4 | Glioblastoma | 0.733333 | 0.846154 | 0.647059 |
| PTPRZ1 AND ITGAV | Glioblastoma | 0.866667 | 1 | 0.764706 |
| BMPR1B AND HAVCR2 | Glioblastoma | 0.764706 | 0.764706 | 0.764706 |
| FZD3 AND AXL | Glioblastoma | 0.666667 | 0.6875 | 0.647059 |
| NRCAM AND CD33 | Glioblastoma | 0.651163 | 0.538462 | 0.823529 |
| BMPR1B AND IGDCC4 | Glioblastoma | 0.651163 | 0.538462 | 0.823529 |
| NRCAM AND SLC39A6 | Glioblastoma | 0.651163 | 0.538462 | 0.823529 |
| BMPR1B AND CD86 | Glioblastoma | 0.709677 | 0.785714 | 0.647059 |
| GPM6B AND VCAM1 | Glioblastoma | 0.65 | 0.565217 | 0.764706 |
| AQP4 AND PROM1 | Glioblastoma | 0.648649 | 0.6 | 0.705882 |
| AQP4 AND SLC7A5 | Glioblastoma | 0.648649 | 0.6 | 0.705882 |
| NCAM1 AND JAM2 | Glioblastoma | 0.758621 | 0.916667 | 0.647059 |
| BMPR1B AND MERTK | Glioblastoma | 0.65 | 0.565217 | 0.764706 |
| FZD3 AND CD33 | Glioblastoma | 0.645161 | 0.714286 | 0.588235 |
| GRIA3 AND MUC1 | Glioblastoma | 0.642857 | 0.818182 | 0.529412 |
| BMPR1B AND CD300A | Glioblastoma | 0.666667 | 0.631579 | 0.705882 |
| PTPRZ1 AND EPHA3 | Glioblastoma | 0.64 | 1 | 0.470588 |
| PTPRZ1 AND EGFR | Glioblastoma | 0.64 | 1 | 0.470588 |
| PTPRZ1 AND STEAP1 | Glioblastoma | 0.64 | 1 | 0.470588 |
| GPM6A AND ITGAV | Glioma | 0.94964 | 0.942857 | 0.956522 |
| GPM6B AND ITGAV | Glioma | 0.93617 | 0.916667 | 0.956522 |
| PTPRZ1 AND ITGAV | Glioma | 0.985294 | 1 | 0.971014 |
| NRCAM AND CD276 | Glioma | 0.931298 | 0.983871 | 0.884058 |
| NLGN1 AND ITGAV | Glioma | 0.930233 | 1 | 0.869565 |
| NRCAM AND ITGAV | Glioma | 0.921875 | 1 | 0.855072 |
| PTPRZ1 AND SLC39A6 | Glioma | 0.970149 | 1 | 0.942029 |
| NRCAM AND ABCB5 | Glioma | 0.917293 | 0.953125 | 0.884058 |
| NRCAM AND SLC34A2 | Glioma | 0.917293 | 0.953125 | 0.884058 |
| NRCAM AND VTCN1 | Glioma | 0.917293 | 0.953125 | 0.884058 |
| NRCAM AND GUCY2C | Glioma | 0.917293 | 0.953125 | 0.884058 |
| NRCAM AND FCRL5 | Glioma | 0.917293 | 0.953125 | 0.884058 |
| PTPRZ1 AND NCAM1 | Glioma | 0.985507 | 0.985507 | 0.985507 |
| NRCAM AND SLAMF7 | Glioma | 0.917293 | 0.953125 | 0.884058 |
| NRCAM AND SSTR4 | Glioma | 0.917293 | 0.953125 | 0.884058 |
| NRCAM AND CLDN7 | Glioma | 0.917293 | 0.953125 | 0.884058 |
| NRCAM AND CD180 | Glioma | 0.917293 | 0.953125 | 0.884058 |
| NRCAM AND SSTR3 | Glioma | 0.917293 | 0.953125 | 0.884058 |
| NRCAM AND ENG | Glioma | 0.917293 | 0.953125 | 0.884058 |
| NRCAM AND MUC4 | Glioma | 0.917293 | 0.953125 | 0.884058 |
| NRCAM AND MUC13 | Glioma | 0.917293 | 0.953125 | 0.884058 |
| PTPRZ1 AND CD276 | Glioma | 0.985294 | 1 | 0.971014 |
| NRCAM AND GPA33 | Glioma | 0.917293 | 0.953125 | 0.884058 |
| NRCAM AND CLDN23 | Glioma | 0.917293 | 0.953125 | 0.884058 |
| APLP1 AND ITGAV | Glioma | 0.920863 | 0.914286 | 0.927536 |
| NLGN4X AND ITGAV | Glioma | 0.923077 | 0.983607 | 0.869565 |
| NRCAM AND RAET1E | Glioma | 0.917293 | 0.953125 | 0.884058 |

FIG. 8 (Cont.)

| Antigen Pair Logic | Cancer (short name) | F1 | Precision | Recall |
|---|---|---|---|---|
| ADAM12 AND BTN3A2 | Liposarcoma | 0.681818 | 0.576923 | 0.833333 |
| PON2 AND TACSTD2 | Lung Adenocarcinoma | 0.637168 | 0.837209 | 0.514286 |
| OSMR AND TLCD1 | Lung Adenocarcinoma | 0.618182 | 0.85 | 0.485714 |
| PON2 AND CDH3 | Lung Adenocarcinoma | 0.654545 | 0.9 | 0.514286 |
| VMP1 AND NTM | Lung Adenocarcinoma | 0.616667 | 0.74 | 0.528571 |
| OSMR AND GOLM1 | Lung Adenocarcinoma | 0.615385 | 0.765957 | 0.514286 |
| OSMR AND XPR1 | Lung Adenocarcinoma | 0.612613 | 0.829268 | 0.485714 |
| VMP1 AND WNT3 | Lung Adenocarcinoma | 0.633333 | 0.76 | 0.542857 |
| PSENEN AND GJA1 | Lung Adenocarcinoma | 0.608696 | 0.777778 | 0.5 |
| VMP1 AND FGG | Lung Adenocarcinoma | 0.607143 | 0.809524 | 0.485714 |
| OSMR AND ATP1B1 | Lung Adenocarcinoma | 0.626087 | 0.8 | 0.514286 |
| TREM1 AND PON2 | Lung Adenocarcinoma | 0.62963 | 0.894737 | 0.485714 |
| OSMR AND C1orf210 | Lung Adenocarcinoma | 0.6 | 0.72 | 0.514286 |
| OSMR AND BCAP31 | Lung Adenocarcinoma | 0.6 | 0.72 | 0.514286 |
| OSMR AND SLC39A11 | Lung Adenocarcinoma | 0.610169 | 0.75 | 0.514286 |
| PON2 AND AGTRAP | Lung Adenocarcinoma | 0.612613 | 0.829268 | 0.485714 |
| OLR1 AND PON2 | Lung Adenocarcinoma | 0.608696 | 0.777778 | 0.5 |
| PON2 AND LAMP3 | Lung Adenocarcinoma | 0.630631 | 0.853659 | 0.5 |
| TREM1 AND KCNK5 | Lung Adenocarcinoma | 0.6 | 0.825 | 0.471429 |
| PON2 AND KCNJ15 | Lung Adenocarcinoma | 0.605505 | 0.846154 | 0.471429 |
| PTPRCAP AND SLC2A5 | B-Cell Diffuse | 0.782609 | 0.84375 | 0.72973 |
| CD48 AND SLC2A5 | B-Cell Diffuse | 0.757576 | 0.862069 | 0.675676 |
| CXCL9 AND GPR18 | B-Cell Diffuse | 0.732394 | 0.764706 | 0.702703 |
| PTPRCAP AND KCNMA1 | B-Cell Diffuse | 0.732394 | 0.764706 | 0.702703 |
| CXCL9 AND ITGAE | B-Cell Diffuse | 0.732394 | 0.764706 | 0.702703 |
| IL2RB AND CDH5 | Anaplastic Lymphoma | 0.740741 | 0.833333 | 0.666667 |
| IL2RB AND GJA1 | Anaplastic Lymphoma | 0.692308 | 0.818182 | 0.6 |
| IL2RB AND OSMR | Anaplastic Lymphoma | 0.692308 | 0.818182 | 0.6 |
| IL2RB AND RAMP3 | Anaplastic Lymphoma | 0.64 | 0.8 | 0.533333 |
| IL2RB AND ECSCR | Anaplastic Lymphoma | 0.615385 | 0.727273 | 0.533333 |
| CXCL9 AND IL2RB | Anaplastic Lymphoma | 0.615385 | 0.727273 | 0.533333 |
| IL2RB AND GJA4 | Anaplastic Lymphoma | 0.740741 | 0.833333 | 0.666667 |
| CD2 AND CDH5 | Anaplastic Lymphoma | 0.615385 | 0.727273 | 0.533333 |
| CXCL9 AND IL2RB | T-Cell, Peripheral | 0.8 | 0.814815 | 0.785714 |
| CXCL9 AND SIRPG | T-Cell, Peripheral | 0.816327 | 0.952381 | 0.714286 |
| CXCL9 AND CD3G | T-Cell, Peripheral | 0.763636 | 0.777778 | 0.75 |
| CXCL9 AND TRPV5 | T-Cell, Peripheral | 0.75 | 0.9 | 0.642857 |
| CXCL9 AND KIAA0754 | T-Cell, Peripheral | 0.769231 | 0.833333 | 0.714286 |
| CXCL9 AND PTPRC | T-Cell, Peripheral | 0.75 | 0.75 | 0.75 |
| PTPRM AND C11orf24 | Melanoma | 0.9 | 1 | 0.818182 |
| C11orf24 AND BCAP31 | Melanoma | 0.9 | 1 | 0.818182 |
| C11orf24 AND PRCP | Melanoma | 0.9 | 1 | 0.818182 |
| C11orf24 AND NPC1 | Melanoma | 0.9 | 1 | 0.818182 |
| TNFSF9 AND VMP1 | Melanoma | 0.952381 | 1 | 0.909091 |
| MC1R AND VMP1 | Melanoma | 0.9 | 1 | 0.818182 |
| MC1R AND STOM | Melanoma | 0.9 | 1 | 0.818182 |
| TNFSF9 AND STOM | Melanoma | 0.952381 | 1 | 0.909091 |
| PTPRZ1 AND GPR52 | Oligodendroglioma | 0.888889 | 1 | 0.8 |
| GRIA2 AND CALCRL | Oligodendroglioma | 0.888889 | 1 | 0.8 |
| PCDHGC3 AND GPM6B | Oligodendroglioma | 0.888889 | 1 | 0.8 |
| GPM6A AND CALCRL | Oligodendroglioma | 0.888889 | 1 | 0.8 |
| GRIA2 AND VANGL2 | Oligodendroglioma | 0.888889 | 1 | 0.8 |
| PTPRZ1 AND ADAM22 | Oligodendroglioma | 0.888889 | 1 | 0.8 |
| NRCAM AND TSPAN11 | Oligodendroglioma | 0.928571 | 1 | 0.866667 |
| REEP2 AND CALCRL | Oligodendroglioma | 0.888889 | 1 | 0.8 |
| GPM6B AND BMP2 | Oligodendroglioma | 0.857143 | 0.923077 | 0.8 |
| PTPRZ1 AND CLEC1A | Oligodendroglioma | 0.888889 | 1 | 0.8 |
| PTPRZ1 AND ANTXR1 | Oligodendroglioma | 0.888889 | 1 | 0.8 |
| GPRC5B AND TSPAN11 | Oligodendroglioma | 0.848485 | 0.777778 | 0.933333 |
| SCAMP5 AND VANGL2 | Oligodendroglioma | 0.888889 | 1 | 0.8 |
| PCDHGC3 AND PTPRZ1 | Oligodendroglioma | 0.846154 | 1 | 0.733333 |
| PTPRZ1 AND TMPRSS5 | Oligodendroglioma | 0.846154 | 1 | 0.733333 |
| PTPRZ1 AND OR51B2 | Oligodendroglioma | 0.846154 | 1 | 0.733333 |
| PTPRZ1 AND TREM1 | Oligodendroglioma | 0.846154 | 1 | 0.733333 |
| PTPRZ1 AND VIPR2 | Oligodendroglioma | 0.846154 | 1 | 0.733333 |
| NLGN1 AND VANGL2 | Oligodendroglioma | 0.846154 | 1 | 0.733333 |
| PCDHGC3 AND PON2 | Oligodendroglioma | 0.846154 | 1 | 0.733333 |
| PTPRZ1 AND FCRL3 | Oligodendroglioma | 0.846154 | 1 | 0.733333 |
| PTPRZ1 AND TNFSF18 | Oligodendroglioma | 0.846154 | 1 | 0.733333 |
| PTPRZ1 AND DLL1 | Oligodendroglioma | 0.846154 | 1 | 0.733333 |
| PTPRZ1 AND CALCRL | Oligodendroglioma | 0.846154 | 1 | 0.733333 |
| PTPRZ1 AND CHRNA5 | Oligodendroglioma | 0.846154 | 1 | 0.733333 |
| PTPRZ1 AND CD300LF | Oligodendroglioma | 0.846154 | 1 | 0.733333 |
| REEP2 AND VANGL2 | Oligodendroglioma | 0.846154 | 1 | 0.733333 |
| GRIA2 AND ANTXR1 | Oligodendroglioma | 0.928571 | 1 | 0.866667 |
| PCDHGC3 AND TSPAN7 | Oligodendroglioma | 0.888889 | 1 | 0.8 |
| KCNK15 AND PCDH19 | Ovarian | 0.869565 | 0.909091 | 0.833333 |
| NRCAM AND CD52 | Glioma | 0.917293 | 0.953125 | 0.884058 |
| NRCAM AND TNFRSF17 | Glioma | 0.917293 | 0.953125 | 0.884058 |
| NRCAM AND ULBP2 | Glioma | 0.917293 | 0.953125 | 0.884058 |
| NRCAM AND TNFRSF13C | Glioma | 0.917293 | 0.953125 | 0.884058 |
| NRCAM AND CD34 | Glioma | 0.917293 | 0.953125 | 0.884058 |
| NRCAM AND MS4A1 | Glioma | 0.917293 | 0.953125 | 0.884058 |
| NRCAM AND ROR1 | Glioma | 0.917293 | 0.953125 | 0.884058 |
| NRCAM AND PTK7 | Glioma | 0.909091 | 0.952381 | 0.869565 |
| NRCAM AND CA9 | Glioma | 0.909091 | 0.952381 | 0.869565 |
| NRCAM AND TNFSF11 | Glioma | 0.909091 | 0.952381 | 0.869565 |
| NRCAM AND FCRL1 | Glioma | 0.909091 | 0.952381 | 0.869565 |
| NRCAM AND IL2RA | Glioma | 0.909091 | 0.952381 | 0.869565 |
| NRCAM AND CD19 | Glioma | 0.909091 | 0.952381 | 0.869565 |
| TNFSF4 AND GPNMB | Leiomyosarcoma | 0.631579 | 1 | 0.461538 |
| FGFR1 AND ULBP2 | Leiomyosarcoma | 0.727273 | 0.888889 | 0.615385 |
| FLT3 AND CD37 | AML | 0.935818 | 0.974138 | 0.900398 |
| ATP8B4 AND CD70 | AML | 0.884532 | 0.975962 | 0.808765 |
| ADAM12 AND FOLH1 | Liposarcoma | 0.765432 | 0.688889 | 0.861111 |
| ADAM12 AND IL2RA | Liposarcoma | 0.756098 | 0.673913 | 0.861111 |
| ADAM12 AND ULBP2 | Liposarcoma | 0.681319 | 0.563636 | 0.861111 |
| OSMR AND EPCAM | Lung Adenocarcinoma | 0.666667 | 0.947368 | 0.514286 |
| EPCAM AND SLC39A10 | Lung Adenocarcinoma | 0.629921 | 0.701754 | 0.571429 |
| VMP1 AND FAP | Lung Adenocarcinoma | 0.628099 | 0.745098 | 0.542857 |
| CXCR4 AND SDC1 | Lung Adenocarcinoma | 0.615385 | 0.765957 | 0.514286 |
| VMP1 AND SLC34A2 | Lung Adenocarcinoma | 0.661017 | 0.8125 | 0.557143 |
| SLC34A2 AND NTM | Lung Adenocarcinoma | 0.611111 | 0.594595 | 0.628571 |
| OLR1 AND SDC1 | Lung Adenocarcinoma | 0.610169 | 0.75 | 0.514286 |
| CLEC7A AND EPCAM | Lung Adenocarcinoma | 0.608696 | 0.777778 | 0.5 |
| TSPAN4 AND CLDN7 | Lung Adenocarcinoma | 0.645161 | 0.740741 | 0.571429 |
| PON2 AND FOLR1 | Lung Adenocarcinoma | 0.614035 | 0.795455 | 0.5 |
| SLC34A2 AND SLC2A5 | Lung Adenocarcinoma | 0.608 | 0.690909 | 0.542857 |
| CLEC5A AND EPCAM | Lung Adenocarcinoma | 0.605505 | 0.846154 | 0.471429 |
| VMP1 AND SDC1 | Lung Adenocarcinoma | 0.654545 | 0.9 | 0.514286 |
| SLC34A2 AND PON2 | Lung Adenocarcinoma | 0.603774 | 0.888889 | 0.457143 |
| TREM1 AND SDC1 | Lung Adenocarcinoma | 0.603448 | 0.76087 | 0.5 |
| SLC34A2 AND SLC41A2 | Lung Adenocarcinoma | 0.603175 | 0.678571 | 0.542857 |
| EPCAM AND VAMP5 | Lung Adenocarcinoma | 0.603175 | 0.678571 | 0.542857 |
| FAP AND GPRC5A | Lung Adenocarcinoma | 0.6 | 0.825 | 0.471429 |
| PON2 AND PTK7 | Lung Adenocarcinoma | 0.62069 | 0.782609 | 0.514286 |
| SLC34A2 AND WNT3 | Lung Adenocarcinoma | 0.650794 | 0.732143 | 0.585714 |
| EPCAM AND PLXND1 | Lung Adenocarcinoma | 0.606061 | 0.645161 | 0.571429 |
| SLC34A2 AND CDH5 | Lung Adenocarcinoma | 0.606061 | 0.526316 | 0.714286 |
| FAP AND PON2 | Lung Adenocarcinoma | 0.616822 | 0.891892 | 0.471429 |
| MAGEA11 AND SLC7A13 | Lung Carcinoma | 0.606061 | 0.857143 | 0.46875 |
| CXCL9 AND CD79B | B-Cell Diffuse | 0.793651 | 0.961538 | 0.675676 |
| CXCL9 AND FCRL5 | B-Cell Diffuse | 0.761905 | 0.923077 | 0.648649 |
| CXCL9 AND CXCR5 | B-Cell Diffuse | 0.754098 | 0.958333 | 0.621622 |
| CXCL9 AND P2RX5 | B-Cell Diffuse | 0.753623 | 0.8125 | 0.702703 |
| MCOLN2 AND CD180 | B-Cell Diffuse | 0.764706 | 0.83871 | 0.702703 |
| FCRL3 AND GPNMB | B-Cell Diffuse | 0.736842 | 0.717949 | 0.756757 |
| CXCL9 AND CR2 | B-Cell Diffuse | 0.754098 | 0.958333 | 0.621622 |
| CD79B AND RAMP3 | B-Cell Diffuse | 0.746269 | 0.833333 | 0.675676 |
| PTPRCAP AND GPNMB | B-Cell Diffuse | 0.735294 | 0.806452 | 0.675676 |
| CXCL9 AND CD72 | B-Cell Diffuse | 0.733333 | 0.956522 | 0.594595 |
| CD79B AND PPAP2B | B-Cell Diffuse | 0.727273 | 0.827586 | 0.648649 |
| CD79B AND ENPP2 | B-Cell Diffuse | 0.727273 | 0.827586 | 0.648649 |
| CD79B AND TNFRSF9 | B-Cell Diffuse | 0.727273 | 0.827586 | 0.648649 |
| CD79B AND SLCO2B1 | B-Cell Diffuse | 0.727273 | 0.827586 | 0.648649 |
| MCOLN2 AND GPNMB | B-Cell Diffuse | 0.764706 | 0.83871 | 0.702703 |
| CD79B AND CDH5 | B-Cell Diffuse | 0.727273 | 0.827586 | 0.648649 |
| CD79A AND BRCA1 | B-Cell Diffuse | 0.727273 | 0.827586 | 0.648649 |
| CD79B AND TMEM119 | B-Cell Diffuse | 0.727273 | 0.827586 | 0.648649 |
| CD79B AND ECSCR | B-Cell Diffuse | 0.716418 | 0.8 | 0.648649 |
| CD40 AND GPNMB | B-Cell Diffuse | 0.716418 | 0.8 | 0.648649 |
| TNFRSF9 AND GPNMB | B-Cell Diffuse | 0.714286 | 0.757576 | 0.675676 |
| CD40 AND VCAM1 | B-Cell Diffuse | 0.712329 | 0.722222 | 0.702703 |
| CLECL1 AND GPNMB | B-Cell Diffuse | 0.711864 | 0.954545 | 0.567568 |
| CD79B AND MRGPRX4 | B-Cell Diffuse | 0.724638 | 0.78125 | 0.675676 |
| CD79A AND SLC2A5 | B-Cell Diffuse | 0.738462 | 0.857143 | 0.648649 |
| MCOLN2 AND P2RX5 | B-Cell Diffuse | 0.716418 | 0.8 | 0.648649 |
| CD79B AND OSMR | B-Cell Diffuse | 0.707692 | 0.821429 | 0.621622 |
| CD79B AND DDR2 | B-Cell Diffuse | 0.707692 | 0.821429 | 0.621622 |
| CD79B AND GJA1 | B-Cell Diffuse | 0.707692 | 0.821429 | 0.621622 |
| CD79B AND AQP1 | B-Cell Diffuse | 0.707692 | 0.821429 | 0.621622 |
| CD79B AND MCAM | B-Cell Diffuse | 0.705882 | 0.774194 | 0.648649 |
| CD79A AND SLC1A3 | B-Cell Diffuse | 0.705882 | 0.774194 | 0.648649 |
| P2RX5 AND ENPP2 | B-Cell Diffuse | 0.704225 | 0.735294 | 0.675676 |

FIG. 8 (Cont.)

| Antigen Pair Logic | Cancer (short name) | F1 | Precision | Recall |
|---|---|---|---|---|
| KCNK15 AND SLC26A7 | Ovarian | 0.857143 | 1 | 0.75 |
| KCNK15 AND TACR2 | Ovarian | 0.909091 | 1 | 0.833333 |
| ADAM12 AND CD99 | Sarcoma | 0.785714 | 1 | 0.647059 |
| DDR2 AND SLC20A1 | Sarcoma | 0.8 | 0.923077 | 0.705882 |
| ADAM12 AND VMP1 | Sarcoma | 0.866667 | 1 | 0.764706 |
| OSMR AND TNFSF4 | Sarcoma | 0.827586 | 1 | 0.705882 |
| ADAM12 AND HLA-B | Sarcoma | 0.969697 | 1 | 0.941176 |
| OSMR AND ITGA11 | Sarcoma | 0.827586 | 1 | 0.705882 |
| OSMR AND PDGFRB | Sarcoma | 0.875 | 0.933333 | 0.823529 |
| TSPAN8 AND FXYD5 | Stomach | 0.860759 | 0.944444 | 0.790698 |
| GOLM1 AND FXYD5 | Stomach | 0.8 | 0.765957 | 0.837209 |
| LSR AND FXYD5 | Stomach | 0.915663 | 0.95 | 0.883721 |
| VSIG1 AND PTPRK | Stomach | 0.735294 | 1 | 0.581395 |
| VSIG1 AND GPRC5A | Stomach | 0.735294 | 1 | 0.581395 |
| VSIG1 AND PMEPA1 | Stomach | 0.724638 | 0.961538 | 0.581395 |
| VSIG1 AND LRP11 | Stomach | 0.724638 | 0.961538 | 0.581395 |
| VSIG1 AND CD151 | Stomach | 0.724638 | 0.961538 | 0.581395 |
| GJB1 AND FXYD5 | Stomach | 0.95122 | 1 | 0.906977 |
| PTPRH AND FXYD5 | Stomach | 0.879121 | 0.833333 | 0.930233 |
| TSPAN8 AND MCAM | Stomach | 0.785714 | 0.804878 | 0.767442 |
| TM4SF5 AND FXYD5 | Stomach | 0.941176 | 0.952381 | 0.930233 |
| B3GNT3 AND FXYD5 | Stomach | 0.97619 | 1 | 0.953488 |
| VSIG1 AND PON2 | Stomach | 0.716418 | 1 | 0.55814 |
| VSIG1 AND PDPN | Stomach | 0.716418 | 1 | 0.55814 |
| VSIG1 AND MYOF | Stomach | 0.716418 | 1 | 0.55814 |
| VSIG1 AND EMP1 | Stomach | 0.714286 | 0.925926 | 0.581395 |
| SYT13 AND FXYD5 | Stomach | 0.953488 | 0.953488 | 0.953488 |
| VSIG1 AND TSPAN3 | Stomach | 0.735294 | 1 | 0.581395 |
| VSIG1 AND PERP | Stomach | 0.714286 | 0.925926 | 0.581395 |
| VSIG1 AND ITGA2 | Stomach | 0.716418 | 1 | 0.55814 |
| VSIG1 AND LTBR | Stomach | 0.735294 | 1 | 0.581395 |
| VSIG1 AND ATP1A1 | Stomach | 0.716418 | 1 | 0.55814 |
| VSIG1 AND GJB2 | Stomach | 0.724638 | 0.961538 | 0.581395 |
| VSIG1 AND ST14 | Stomach | 0.705882 | 0.96 | 0.55814 |
| VSIG1 AND CLSTN1 | Stomach | 0.705882 | 0.96 | 0.55814 |
| VSIG1 AND PLXNA1 | Stomach | 0.704225 | 0.892857 | 0.581395 |
| VSIG1 AND PPAP2C | Stomach | 0.704225 | 0.892857 | 0.581395 |
| VSIG1 AND LGR4 | Stomach | 0.724638 | 0.961538 | 0.581395 |
| VSIG1 AND EMP2 | Stomach | 0.714286 | 0.925926 | 0.581395 |
| TM4SF5 AND CDH3 | Stomach | 0.795181 | 0.825 | 0.767442 |
| VSIG1 AND LSR | Stomach | 0.704225 | 0.892857 | 0.581395 |
| IYD AND FXYD5 | Stomach | 0.860759 | 0.944444 | 0.790698 |
| TSPAN8 AND EDNRA | Stomach | 0.842105 | 0.969697 | 0.744186 |
| VSIG1 AND FZD6 | Stomach | 0.716418 | 1 | 0.55814 |
| VSIG1 AND WNT5A | Stomach | 0.69697 | 1 | 0.534884 |
| VSIG1 AND TM4SF1 | Stomach | 0.69697 | 1 | 0.534884 |
| VSIG1 AND GJA1 | Stomach | 0.69697 | 1 | 0.534884 |
| VSIG1 AND DSG2 | Stomach | 0.704225 | 0.892857 | 0.581395 |
| VSIG1 AND LDLR | Stomach | 0.714286 | 0.925926 | 0.581395 |
| VSIG1 AND PTPRF | Stomach | 0.704225 | 0.892857 | 0.581395 |
| VSIG1 AND SLCO2B1 | Stomach | 0.695652 | 0.923077 | 0.55814 |
| VSIG1 AND CD9 | Stomach | 0.695652 | 0.923077 | 0.55814 |
| VSIG1 AND DAG1 | Stomach | 0.695652 | 0.923077 | 0.55814 |
| VSIG1 AND OSMR | Stomach | 0.694444 | 0.862069 | 0.581395 |
| VSIG1 AND TNFRSF21 | Stomach | 0.694444 | 0.862069 | 0.581395 |
| VSIG1 AND EPHB4 | Stomach | 0.694444 | 0.862069 | 0.581395 |
| PTPRH AND TACSTD2 | Stomach | 0.831461 | 0.804348 | 0.860465 |
| VSIG1 AND ABHD12 | Stomach | 0.716418 | 1 | 0.55814 |
| VSIG1 AND AKAP1 | Stomach | 0.694444 | 0.862069 | 0.581395 |
| VSIG1 AND PRRG1 | Stomach | 0.694444 | 0.862069 | 0.581395 |
| KCNE3 AND DIO2 | Stomach | 0.787234 | 0.72549 | 0.860465 |
| TSPAN8 AND PDGFRB | Stomach | 0.842105 | 0.969697 | 0.744186 |
| LSR AND TNFSF15 | Stomach | 0.840909 | 0.822222 | 0.860465 |
| VSIG1 AND SPINT1 | Stomach | 0.735294 | 1 | 0.581395 |
| VSIG1 AND SDF4 | Stomach | 0.695652 | 0.923077 | 0.55814 |
| VSIG1 AND TNFRSF11A | Stomach | 0.735294 | 1 | 0.581395 |
| VSIG1 AND S100A10 | Stomach | 0.714286 | 0.925926 | 0.581395 |
| VSIG1 AND ATP2A2 | Stomach | 0.714286 | 0.925926 | 0.581395 |
| TSPAN1 AND FXYD5 | Stomach | 0.934783 | 0.877551 | 1 |
| TM4SF5 AND PDPN | Stomach | 0.808511 | 0.745098 | 0.883721 |
| VSIG1 AND SGCB | Stomach | 0.716418 | 1 | 0.55814 |
| TSPAN8 AND PDPN | Stomach | 0.780488 | 0.820513 | 0.744186 |
| VSIG1 AND B3GNT3 | Stomach | 0.694444 | 0.862069 | 0.581395 |
| VSIG1 AND FAM57A | Stomach | 0.704225 | 0.892857 | 0.581395 |
| VSIG1 AND NRP1 | Stomach | 0.686567 | 0.958333 | 0.534884 |
| VSIG1 AND CAV2 | Stomach | 0.685714 | 0.888889 | 0.55814 |
| VSIG1 AND AQP1 | Stomach | 0.685714 | 0.888889 | 0.55814 |
| CD180 AND SLC2A5 | B-Cell Diffuse | 0.75 | 0.771429 | 0.72973 |
| MS4A1 AND CELSR1 | Mantle-Cell Lymphoma | 0.962025 | 0.926829 | 1 |
| MS4A1 AND ST14 | Mantle-Cell Lymphoma | 0.944444 | 1 | 0.894737 |
| MS4A1 AND CLECL1 | Mantle-Cell Lymphoma | 0.894118 | 0.808511 | 1 |
| P2RX5 AND PKD2L1 | Mantle-Cell Lymphoma | 0.933333 | 0.945946 | 0.921053 |
| P2RX5 AND STRA6 | Mantle-Cell Lymphoma | 0.935065 | 0.923077 | 0.947368 |
| P2RX5 AND CELSR1 | Mantle-Cell Lymphoma | 0.909091 | 0.897436 | 0.921053 |
| MS4A1 AND KCNN4 | Mantle-Cell Lymphoma | 0.974359 | 0.95 | 1 |
| P2RX5 AND MRGPRX4 | Mantle-Cell Lymphoma | 0.894737 | 0.894737 | 0.894737 |
| P2RX5 AND SLC13A3 | Mantle-Cell Lymphoma | 0.909091 | 0.897436 | 0.921053 |
| P2RX5 AND TSPAN1 | Mantle-Cell Lymphoma | 0.876712 | 0.914286 | 0.842105 |
| CD52 AND KCNN4 | Mantle-Cell Lymphoma | 0.888889 | 0.837209 | 0.947368 |
| P2RX5 AND OR2S2 | Mantle-Cell Lymphoma | 0.911392 | 0.878049 | 0.947368 |
| P2RX5 AND IL17RC | Mantle-Cell Lymphoma | 0.891892 | 0.916667 | 0.868421 |
| P2RX5 AND ADAM15 | Mantle-Cell Lymphoma | 0.868421 | 0.868421 | 0.868421 |
| CD52 AND ST14 | Mantle-Cell Lymphoma | 0.882353 | 1 | 0.789474 |
| P2RX5 AND ST14 | Mantle-Cell Lymphoma | 0.865672 | 1 | 0.763158 |
| P2RX5 AND LRRC32 | Mantle-Cell Lymphoma | 0.9 | 0.857143 | 0.947368 |
| P2RX5 AND P2RX2 | Mantle-Cell Lymphoma | 0.923077 | 0.9 | 0.947368 |
| P2RX5 AND SLC22A24 | Mantle-Cell Lymphoma | 0.935065 | 0.923077 | 0.947368 |
| P2RX5 AND PTH1R | Mantle-Cell Lymphoma | 0.911392 | 0.878049 | 0.947368 |
| P2RX5 AND TIE1 | Mantle-Cell Lymphoma | 0.911392 | 0.878049 | 0.947368 |
| P2RX5 AND KCNE2 | Mantle-Cell Lymphoma | 0.894737 | 0.894737 | 0.894737 |
| P2RX5 AND SLC34A3 | Mantle-Cell Lymphoma | 0.933333 | 0.945946 | 0.921053 |
| P2RX5 AND KCNK1 | Mantle-Cell Lymphoma | 0.911392 | 0.878049 | 0.947368 |
| P2RX5 AND EDNRA | Mantle-Cell Lymphoma | 0.86747 | 0.8 | 0.947368 |
| P2RX5 AND HEPH | Mantle-Cell Lymphoma | 0.861111 | 0.911765 | 0.815789 |
| P2RX5 AND UPK2 | Mantle-Cell Lymphoma | 0.897436 | 0.875 | 0.921053 |
| P2RX5 AND OR5184 | Mantle-Cell Lymphoma | 0.86747 | 0.8 | 0.947368 |
| MS4A1 AND LRRC32 | Mantle-Cell Lymphoma | 0.853933 | 0.745098 | 1 |
| P2RX5 AND FUT1 | Mantle-Cell Lymphoma | 0.853333 | 0.864865 | 0.842105 |
| P2RX5 AND FXYD3 | Mantle-Cell Lymphoma | 0.911392 | 0.878049 | 0.947368 |
| P2RX5 AND CLSTN2 | Mantle-Cell Lymphoma | 0.886076 | 0.853659 | 0.921053 |
| P2RX5 AND TMEM150B | Mantle-Cell Lymphoma | 0.911392 | 0.878049 | 0.947368 |
| P2RX5 AND ABCC8 | Mantle-Cell Lymphoma | 0.911392 | 0.878049 | 0.947368 |
| P2RX5 AND PROKR2 | Mantle-Cell Lymphoma | 0.935065 | 0.923077 | 0.947368 |
| P2RX5 AND DCHS2 | Mantle-Cell Lymphoma | 0.888889 | 0.837209 | 0.947368 |
| P2RX5 AND AGTR1 | Mantle-Cell Lymphoma | 0.878049 | 0.818182 | 0.947368 |
| P2RX5 AND OR51M1 | Mantle-Cell Lymphoma | 0.9 | 0.857143 | 0.947368 |
| P2RX5 AND FAQR5 | Mantle-Cell Lymphoma | 0.891892 | 0.916667 | 0.868421 |
| P2RX5 AND PCDHB12 | Mantle-Cell Lymphoma | 0.923077 | 0.9 | 0.947368 |
| P2RX5 AND FCRL4 | Mantle-Cell Lymphoma | 0.878049 | 0.818182 | 0.947368 |
| P2RX5 AND FAIM2 | Mantle-Cell Lymphoma | 0.90411 | 0.942857 | 0.868421 |
| P2RX5 AND HRH1 | Mantle-Cell Lymphoma | 0.853333 | 0.864865 | 0.842105 |
| CXCL9 AND CR2 | T-Cell, Peripheral | 0.784314 | 0.869565 | 0.714286 |
| CXCL9 AND MS4A1 | T-Cell, Peripheral | 0.740741 | 0.769231 | 0.714286 |
| CXCL9 AND P2RX5 | T-Cell, Peripheral | 0.740741 | 0.769231 | 0.714286 |
| CXCL9 AND CD22 | T-Cell, Peripheral | 0.692308 | 0.75 | 0.642857 |
| CXCL9 AND ULBP2 | T-Cell, Peripheral | 0.72 | 0.818182 | 0.642857 |
| CXCL9 AND IL2RA | T-Cell, Peripheral | 0.679245 | 0.72 | 0.642857 |
| CXCL9 AND CD38 | T-Cell, Peripheral | 0.641509 | 0.68 | 0.607143 |
| CXCL9 AND CD79A | T-Cell, Peripheral | 0.62963 | 0.653846 | 0.607143 |
| TNFSF11 AND IL2RB | T-Cell, Peripheral | 0.619048 | 0.928571 | 0.464286 |
| GPR174 AND GPNMB | T-Cell, Peripheral | 0.638889 | 0.522727 | 0.821429 |
| BTLA AND TPBG | T-Cell, Peripheral | 0.615385 | 0.666667 | 0.571429 |
| TNFSF11 AND CLEC2D | T-Cell, Peripheral | 0.622222 | 0.823529 | 0.5 |
| TNFRSF9 AND TPBG | T-Cell, Peripheral | 0.625 | 0.75 | 0.535714 |
| TNFSF11 AND GPR174 | T-Cell, Peripheral | 0.622222 | 0.823529 | 0.5 |
| ITGAL AND GPNMB | T-Cell, Peripheral | 0.631579 | 0.5 | 0.857143 |
| TNFSF11 AND CD28 | T-Cell, Peripheral | 0.608696 | 0.777778 | 0.5 |
| EDNRB AND IL6R | Melanoma | 0.9 | 1 | 0.818182 |
| EDNRB AND IL1RAP | Melanoma | 0.9 | 1 | 0.818182 |
| EDNRB AND ABCC5 | Melanoma | 0.9 | 1 | 0.818182 |
| EDNRB AND JAG2 | Melanoma | 0.9 | 1 | 0.818182 |
| EDNRB AND CLCN5 | Melanoma | 0.9 | 1 | 0.818182 |
| EDNRB AND JTB | Melanoma | 0.9 | 1 | 0.818182 |
| EDNRB AND GPR37 | Melanoma | 0.9 | 1 | 0.818182 |
| EDNRB AND DLL1 | Melanoma | 0.9 | 1 | 0.818182 |
| EDNRB AND SLC2A8 | Melanoma | 0.9 | 1 | 0.818182 |
| SLC10A4 AND CD276 | Neuroblastoma | 0.953488 | 0.931818 | 0.97619 |
| SLC10A4 AND PTK7 | Neuroblastoma | 0.947977 | 0.921348 | 0.97619 |
| SLC10A4 AND L1CAM | Neuroblastoma | 0.943182 | 0.902174 | 0.988095 |
| SLC10A4 AND CLDN12 | Neuroblastoma | 0.935673 | 0.91954 | 0.952381 |
| CHRNA3 AND THY1 | Neuroblastoma | 0.909091 | 0.925926 | 0.892857 |
| SLC10A4 AND CBX3 | Neuroblastoma | 0.907975 | 0.936709 | 0.880952 |
| GRIA2 AND EGFR | Oligodendroglioma | 0.903226 | 0.875 | 0.933333 |
| GPRC5B AND EGFR | Oligodendroglioma | 0.896552 | 0.928571 | 0.866667 |

FIG. 8 (Cont.)

| Antigen Pair Logic | Cancer (short name) | F1 | Precision | Recall |
|---|---|---|---|---|
| VSIG1 AND CLPTM1 | Stomach | 0.685714 | 0.888889 | 0.55814 |
| VSIG1 AND MFSD10 | Stomach | 0.685714 | 0.888889 | 0.55814 |
| VSIG1 AND SLC4A2 | Stomach | 0.714286 | 0.925926 | 0.581395 |
| VSIG1 AND SLC39A10 | Stomach | 0.684932 | 0.833333 | 0.581395 |
| VSIG1 AND HEPH | Stomach | 0.684932 | 0.833333 | 0.581395 |
| VSIG1 AND ANO1 | Stomach | 0.684932 | 0.833333 | 0.581395 |
| VSIG1 AND SLC12A7 | Stomach | 0.714286 | 0.925926 | 0.581395 |
| VSIG1 AND KCNK1 | Stomach | 0.684932 | 0.833333 | 0.581395 |
| VSIG1 AND CALCRL | Stomach | 0.684932 | 0.833333 | 0.581395 |
| VSIG1 AND APOLD1 | Stomach | 0.684932 | 0.833333 | 0.581395 |
| VSIG1 AND JAG1 | Stomach | 0.684932 | 0.833333 | 0.581395 |
| VSIG1 AND BMPR1A | Stomach | 0.694444 | 0.862069 | 0.581395 |
| LSR AND PDPN | Stomach | 0.86747 | 0.9 | 0.837209 |
| TSPAN8 AND DIO2 | Stomach | 0.717949 | 0.8 | 0.651163 |
| VSIG1 AND BCAP31 | Stomach | 0.714286 | 0.925926 | 0.581395 |
| VSIG1 AND VIMP | Stomach | 0.735294 | 1 | 0.581395 |
| VSIG1 AND CDCP1 | Stomach | 0.694444 | 0.862069 | 0.581395 |
| FXYD6 AND BEST3 | Astrocytoma | 0.831461 | 0.860465 | 0.804348 |
| CRB1 AND F2R | Astrocytoma | 0.795699 | 0.787234 | 0.804348 |
| KCNJ10 AND F2R | Astrocytoma | 0.774194 | 0.765957 | 0.782609 |
| NKAIN4 AND GPR137B | Astrocytoma | 0.772727 | 0.809524 | 0.73913 |
| NKAIN4 AND F2R | Astrocytoma | 0.764045 | 0.790698 | 0.73913 |
| MLC1 AND F2R | Astrocytoma | 0.76087 | 0.76087 | 0.76087 |
| SLCO1C1 AND F2R | Astrocytoma | 0.758621 | 0.804878 | 0.717391 |
| NKAIN4 AND LAPTM5 | Astrocytoma | 0.756098 | 0.861111 | 0.673913 |
| GABBR2 AND F2R | Astrocytoma | 0.782609 | 0.782609 | 0.782609 |
| CRB1 AND BEST3 | Astrocytoma | 0.752941 | 0.820513 | 0.695652 |
| NKAIN4 AND CD44 | Astrocytoma | 0.752941 | 0.820513 | 0.695652 |
| MLC1 AND BEST3 | Astrocytoma | 0.741573 | 0.767442 | 0.717391 |
| GABBR2 AND BEST3 | Astrocytoma | 0.738095 | 0.815789 | 0.673913 |
| NKAIN4 AND SORL1 | Astrocytoma | 0.736842 | 0.933333 | 0.608696 |
| TTYH2 AND BEST3 | Astrocytoma | 0.735632 | 0.780488 | 0.695652 |
| CRB1 AND SEMA4B | Astrocytoma | 0.734694 | 0.692308 | 0.782609 |
| MLC1 AND SEMA4B | Astrocytoma | 0.729167 | 0.7 | 0.76087 |
| KCNJ10 AND BEST3 | Astrocytoma | 0.722892 | 0.810811 | 0.652174 |
| SLC1A2 AND F2R | Astrocytoma | 0.716981 | 0.633333 | 0.826087 |
| SLCO1C1 AND BEST3 | Astrocytoma | 0.708861 | 0.848485 | 0.608696 |
| NKAIN4 AND CXCL16 | Astrocytoma | 0.708861 | 0.848485 | 0.608696 |
| SLCO1C1 AND LAPTM5 | Astrocytoma | 0.707317 | 0.805556 | 0.630435 |
| SLC39A12 AND F2R | Astrocytoma | 0.705882 | 0.769231 | 0.652174 |
| MOG AND F2R | Astrocytoma | 0.704545 | 0.738095 | 0.673913 |
| PPAPDC1A AND VANGL1 | Breast | 0.744681 | 0.875 | 0.648148 |
| PPAPDC1A AND LRRC8E | Breast | 0.76087 | 0.921053 | 0.648148 |
| PPAPDC1A AND ATP8B1 | Breast | 0.77551 | 0.863636 | 0.703704 |
| PPAPDC1A AND VAMP8 | Breast | 0.767677 | 0.844444 | 0.703704 |
| PPAPDC1A AND TGFBI | Breast | 0.765957 | 0.9 | 0.666667 |
| PPAPDC1A AND TNFRSF12A | Breast | 0.715789 | 0.829268 | 0.62963 |
| PPAPDC1A AND AOC3 | Breast | 0.714286 | 0.795455 | 0.648148 |
| BST2 AND VANGL1 | Breast | 0.712644 | 0.939394 | 0.574074 |
| BST2 AND LRRC8E | Breast | 0.727273 | 0.941176 | 0.592593 |
| PPAPDC1A AND SLC22A18 | Breast | 0.709677 | 0.846154 | 0.611111 |
| PPAPDC1A AND F2R | Breast | 0.709677 | 0.846154 | 0.611111 |
| PPAPDC1A AND PPAPDC1B | Breast | 0.762887 | 0.860465 | 0.685185 |
| PPAPDC1A AND PHLDB2 | Breast | 0.74 | 0.804348 | 0.685185 |
| PPAPDC1A AND BST2 | Breast | 0.772727 | 1 | 0.62963 |
| PPAPDC1A AND ANTXR2 | Breast | 0.76 | 0.826087 | 0.703704 |
| PPAPDC1A AND BTN3A1 | Breast | 0.696629 | 0.885714 | 0.574074 |
| ENPP1 AND LRRC8E | Breast | 0.72381 | 0.745098 | 0.703704 |
| PPAPDC1A AND PTGER4 | Breast | 0.711538 | 0.74 | 0.685185 |
| PPAPDC1A AND CXCL16 | Breast | 0.707071 | 0.777778 | 0.648148 |
| PPAPDC1A AND CD163 | Breast | 0.770833 | 0.880952 | 0.685185 |
| PPAPDC1A AND ATP7A | Breast | 0.678899 | 0.672727 | 0.685185 |
| PPAPDC1A AND SLC31A1 | Breast | 0.778947 | 0.902439 | 0.685185 |
| PPAPDC1A AND CD58 | Breast | 0.723404 | 0.85 | 0.62963 |
| PPAPDC1A AND TNFRSF10B | Breast | 0.666667 | 0.708333 | 0.62963 |
| CDH11 AND VANGL1 | Breast | 0.697674 | 0.9375 | 0.555556 |
| PPAPDC1A AND BTN3A3 | Breast | 0.658824 | 0.903226 | 0.518519 |
| PPAPDC1A AND PROCR | Breast | 0.695652 | 0.842105 | 0.592593 |
| PPAPDC1A AND SLC38A1 | Breast | 0.652174 | 0.789474 | 0.555556 |
| PPAPDC1A AND IFNAR2 | Breast | 0.650602 | 0.931034 | 0.5 |
| TNFRSF12A AND VANGL1 | Breast | 0.679612 | 0.714286 | 0.648148 |
| PPAPDC1A AND CDH11 | Breast | 0.65 | 1 | 0.481481 |
| CDH11 AND LRRC8E | Breast | 0.65 | 1 | 0.481481 |
| TNFRSF12A AND LRRC8E | Breast | 0.747253 | 0.918919 | 0.62963 |
| ENPP1 AND LAPTM5 | Breast | 0.704545 | 0.911765 | 0.574074 |
| CDH11 AND FLVCR1 | Breast | 0.714286 | 1 | 0.555556 |
| ENPP1 AND SLC38A1 | Breast | 0.647059 | 0.6875 | 0.611111 |

| Antigen Pair Logic | Cancer (short name) | F1 | Precision | Recall |
|---|---|---|---|---|
| PTPRZ1 AND EGFR | Oligodendroglioma | 0.846154 | 1 | 0.733333 |
| PTPRZ1 AND CD38 | Oligodendroglioma | 0.888889 | 1 | 0.8 |
| GPM6A AND EGFR | Oligodendroglioma | 0.933333 | 0.933333 | 0.933333 |
| NRXN2 AND EGFR | Oligodendroglioma | 0.827586 | 0.857143 | 0.8 |
| NRCAM AND EGFR | Oligodendroglioma | 0.888889 | 1 | 0.8 |
| LSAMP AND EGFR | Oligodendroglioma | 0.827586 | 0.857143 | 0.8 |
| PTPRZ1 AND CD180 | Oligodendroglioma | 0.846154 | 1 | 0.733333 |
| AQP4 AND EGFR | Oligodendroglioma | 0.814815 | 0.916667 | 0.733333 |
| APLP1 AND EGFR | Oligodendroglioma | 0.814815 | 0.916667 | 0.733333 |
| NCAM2 AND EGFR | Oligodendroglioma | 0.888889 | 1 | 0.8 |
| SLC1A3 AND EGFR | Oligodendroglioma | 0.814815 | 0.916667 | 0.733333 |
| PTPRZ1 AND CA9 | Oligodendroglioma | 0.8 | 1 | 0.666667 |
| PTPRZ1 AND CD33 | Oligodendroglioma | 0.8 | 1 | 0.666667 |
| SLC6A1 AND EGFR | Oligodendroglioma | 0.814815 | 0.916667 | 0.733333 |
| NLGN1 AND EGFR | Oligodendroglioma | 0.8 | 1 | 0.666667 |
| SLC22A17 AND EGFR | Oligodendroglioma | 0.928571 | 1 | 0.866667 |
| PTPRZ1 AND CLDN1 | Oligodendroglioma | 0.857143 | 0.923077 | 0.8 |
| ADAM22 AND EGFR | Oligodendroglioma | 0.8 | 0.8 | 0.8 |
| PTPRZ1 AND CR2 | Oligodendroglioma | 0.8 | 1 | 0.666667 |
| PTPRZ1 AND CSPG4 | Oligodendroglioma | 0.8 | 1 | 0.666667 |
| MUC16 AND SLC1A3 | Ovarian | 0.736842 | 1 | 0.583333 |
| KCNK15 AND VTCN1 | Ovarian | 0.736842 | 1 | 0.583333 |
| MUC16 AND SLC16A10 | Ovarian | 0.761905 | 0.888889 | 0.666667 |
| MUC16 AND ADORA3 | Ovarian | 0.727273 | 0.8 | 0.666667 |
| MUC16 AND NRCAM | Ovarian | 0.736842 | 1 | 0.583333 |
| MUC16 AND PCDH19 | Ovarian | 0.666667 | 1 | 0.5 |
| KCNK15 AND SDC1 | Ovarian | 0.666667 | 0.6 | 0.75 |
| MUC16 AND CDH2 | Ovarian | 0.7 | 0.875 | 0.583333 |
| MUC16 AND SUSD3 | Ovarian | 0.761905 | 0.888889 | 0.666667 |
| OR51E2 AND EPCAM | Prostate | 0.857143 | 1 | 0.75 |
| ATP2C1 AND EPCAM | Prostate | 0.857143 | 1 | 0.75 |
| ANO7 AND EPCAM | Prostate | 0.857143 | 1 | 0.75 |
| FAP AND JTB | Sarcoma | 0.785714 | 1 | 0.647059 |
| MUC13 AND FXYD5 | Stomach | 0.965517 | 0.954545 | 0.976744 |
| CLDN18 AND ST14 | Stomach | 0.886076 | 0.972222 | 0.813953 |
| MUC13 AND MCAM | Stomach | 0.901099 | 0.854167 | 0.953488 |
| TSPAN8 AND THY1 | Stomach | 0.815789 | 0.939394 | 0.72093 |
| CLDN18 AND GJB2 | Stomach | 0.9 | 0.972973 | 0.837209 |
| TSPAN1 AND THY1 | Stomach | 0.8 | 0.701754 | 0.930233 |
| MUC13 AND CDH5 | Stomach | 0.91954 | 0.909091 | 0.930233 |
| CLDN18 AND BRCA1 | Stomach | 0.871795 | 0.971429 | 0.790698 |
| CLDN18 AND B3GNT3 | Stomach | 0.847059 | 0.857143 | 0.837209 |
| CLDN18 AND F2RL2 | Stomach | 0.85 | 0.918919 | 0.790698 |
| MUC13 AND PDPN | Stomach | 0.898876 | 0.869565 | 0.930233 |
| CLDN18 AND LGR4 | Stomach | 0.878049 | 0.923077 | 0.837209 |
| CLDN18 AND TM4SF5 | Stomach | 0.875 | 0.945946 | 0.813953 |
| CEACAM5 AND FXYD5 | Stomach | 0.883117 | 1 | 0.790698 |
| CLDN18 AND PPAP2C | Stomach | 0.888889 | 0.947368 | 0.837209 |
| MUC13 AND LDLRAD3 | Stomach | 0.866667 | 0.829787 | 0.906977 |
| MUC13 AND EDNRA | Stomach | 0.963855 | 1 | 0.930233 |
| MUC13 AND PDGFRB | Stomach | 0.941176 | 0.952381 | 0.930233 |
| CLDN18 AND TNFRSF11A | Stomach | 0.911392 | 1 | 0.837209 |
| CLDN18 AND SLC16A1 | Stomach | 0.837209 | 0.837209 | 0.837209 |
| CLDN18 AND F2RL1 | Stomach | 0.911392 | 1 | 0.837209 |
| MUC13 AND APOLD1 | Stomach | 0.875 | 0.792453 | 0.976744 |
| CLDN18 AND GOLM1 | Stomach | 0.843373 | 0.875 | 0.813953 |
| CLDN18 AND TSPAN8 | Stomach | 0.835443 | 0.916667 | 0.767442 |
| MUC13 AND CALCRL | Stomach | 0.880952 | 0.902439 | 0.860465 |
| CLDN18 AND SEMA4G | Stomach | 0.808989 | 0.782609 | 0.837209 |
| CLDN18 AND ABCC3 | Stomach | 0.86747 | 0.9 | 0.837209 |
| CLDN18 AND SLC7A1 | Stomach | 0.888889 | 0.947368 | 0.837209 |
| CLDN18 AND ATP10B | Stomach | 0.772727 | 0.755556 | 0.790698 |
| VSIG1 AND CLDN1 | Stomach | 0.735294 | 1 | 0.581395 |
| CLDN18 AND SYT13 | Stomach | 0.839506 | 0.894737 | 0.790698 |
| CLDN18 AND SLC39A14 | Stomach | 0.837209 | 0.837209 | 0.837209 |
| B3GNT3 AND THY1 | Stomach | 0.952381 | 0.97561 | 0.930233 |
| CLDN18 AND SLC12A2 | Stomach | 0.839506 | 0.894737 | 0.790698 |
| PTPRH AND THY1 | Stomach | 0.83871 | 0.78 | 0.906977 |
| CLDN18 AND DIO2 | Stomach | 0.775 | 0.837838 | 0.72093 |
| CLDN18 AND CDH3 | Stomach | 0.853333 | 1 | 0.744186 |
| EPCAM AND DIO2 | Stomach | 0.747475 | 0.660714 | 0.860465 |
| MUC13 AND IFITM2 | Stomach | 0.911111 | 0.87234 | 0.953488 |
| CEACAM5 AND MCAM | Stomach | 0.777778 | 0.744681 | 0.813953 |
| VSIG1 AND ERBB2 | Stomach | 0.724638 | 0.961538 | 0.581395 |
| NCAM1 AND SLC39A6 | Astrocytoma | 0.606742 | 0.627907 | 0.586957 |
| NCAM1 AND EDNRB | Astrocytoma | 0.606061 | 0.566038 | 0.652174 |
| FAP AND CLDN4 | Breast | 0.791209 | 0.972973 | 0.666667 |

FIG. 8 (Cont.)

| Antigen Pair Logic | Cancer (short name) | F1 | Precision | Recall |
|---|---|---|---|---|
| SLC2A2 AND ALCAM | Liver | 1 | 1 | 1 |
| SLC2A2 AND DTNA | Liver | 0.909091 | 1 | 0.833333 |
| SLC2A2 AND GPR158 | Liver | 0.909091 | 1 | 0.833333 |
| SLC2A2 AND FGF6 | Liver | 0.833333 | 0.833333 | 0.833333 |
| SLC13A5 AND PLVAP | Liver | 0.8 | 1 | 0.666667 |
| SLCO1B1 AND FGF6 | Liver | 0.833333 | 0.833333 | 0.833333 |
| SLCO1B1 AND PLVAP | Liver | 0.8 | 1 | 0.666667 |
| SLC2A2 AND NPFFR1 | Liver | 0.8 | 1 | 0.666667 |
| SLC2A2 AND GABRG3 | Liver | 0.8 | 1 | 0.666667 |
| SLC2A2 AND PCDHB1 | Liver | 0.857143 | 0.75 | 1 |
| SLCO1B1 AND SMPD2 | Liver | 1 | 1 | 1 |
| SLC2A2 AND SLC22A11 | Liver | 0.909091 | 1 | 0.833333 |
| SLC2A2 AND ZACN | Liver | 0.909091 | 1 | 0.833333 |
| SLC2A2 AND SEZ6 | Liver | 0.857143 | 0.75 | 1 |
| SLCO1B1 AND ZACN | Liver | 0.909091 | 1 | 0.833333 |
| SLCO1B1 AND SLC22A12 | Liver | 0.769231 | 0.714286 | 0.833333 |
| SLC2A2 AND MRGPRX2 | Liver | 0.769231 | 0.714286 | 0.833333 |
| SLC2A2 AND KCNJ6 | Liver | 0.909091 | 1 | 0.833333 |
| SLC2A2 AND SLC22A12 | Liver | 0.769231 | 0.714286 | 0.833333 |
| SLC2A2 AND CNTNAP4 | Liver | 0.769231 | 0.714286 | 0.833333 |
| SLCO1B1 AND NPFFR1 | Liver | 0.8 | 1 | 0.666667 |
| SLC2A2 AND SLC12A9 | Liver | 0.8 | 1 | 0.666667 |
| SLC2A2 AND SLC30A8 | Liver | 0.769231 | 0.714286 | 0.833333 |
| ABCG5 AND ALCAM | Liver | 1 | 1 | 1 |
| SLC17A2 AND SLC22A12 | Liver | 0.769231 | 0.714286 | 0.833333 |
| SLC2A2 AND GRM3 | Liver | 0.769231 | 0.714286 | 0.833333 |
| SLCO1B1 AND ALCAM | Liver | 1 | 1 | 1 |
| SLCO1B1 AND KCNJ6 | Liver | 0.909091 | 1 | 0.833333 |
| SLC17A2 AND SMPD2 | Liver | 0.909091 | 1 | 0.833333 |
| SLCO1B1 AND DTNA | Liver | 0.909091 | 1 | 0.833333 |
| SLC2A2 AND SMPD2 | Liver | 1 | 1 | 1 |
| SLC2A2 AND HTR1E | Liver | 0.769231 | 0.714286 | 0.833333 |
| SLC2A2 AND SLC8A3 | Liver | 0.8 | 1 | 0.666667 |
| SLC2A2 AND MAG | Liver | 0.833333 | 0.833333 | 0.833333 |
| SLC2A2 AND UPK3A | Liver | 0.8 | 1 | 0.666667 |
| SLC2A2 AND GRM1 | Liver | 0.857143 | 0.75 | 1 |
| SLCO1B1 AND GABRG3 | Liver | 0.8 | 1 | 0.666667 |
| SLC2A2 AND KCNK16 | Liver | 0.833333 | 0.833333 | 0.833333 |
| SLC43A1 AND ALCAM | Liver | 0.909091 | 1 | 0.833333 |
| SLCO1B1 AND SLC22A5 | Liver | 0.833333 | 0.833333 | 0.833333 |
| SLC2A2 AND ROS1 | Liver | 0.857143 | 0.75 | 1 |
| SLC2A2 AND CACNA1E | Liver | 0.769231 | 0.714286 | 0.833333 |
| SLC2A2 AND GABRA5 | Liver | 0.857143 | 0.75 | 1 |
| SLC2A2 AND PVRL1 | Liver | 0.857143 | 0.75 | 1 |
| SLC2A2 AND SLC43A1 | Liver | 0.909091 | 1 | 0.833333 |
| SLC2A2 AND CLSTN3 | Liver | 0.909091 | 1 | 0.833333 |
| SLCO1B1 AND GPR158 | Liver | 0.75 | 0.6 | 1 |
| SLCO1B1 AND SEZ6 | Liver | 0.75 | 0.6 | 1 |
| SLCO1B1 AND PCDHB1 | Liver | 0.75 | 0.6 | 1 |
| SLCO1B1 AND MUC12 | Liver | 0.833333 | 0.833333 | 0.833333 |
| SLCO1B1 AND SLC30A8 | Liver | 0.75 | 0.6 | 1 |
| SLCO1B1 AND KCNK16 | Liver | 0.833333 | 0.833333 | 0.833333 |
| ABCG5 AND DTNA | Liver | 0.909091 | 1 | 0.833333 |
| SLC17A2 AND ZACN | Liver | 0.8 | 1 | 0.666667 |
| SLCO1B3 AND ALCAM | Liver | 0.8 | 1 | 0.666667 |
| SLCO1B1 AND PVRL1 | Liver | 0.857143 | 0.75 | 1 |
| SLC2A2 AND OPCML | Liver | 0.857143 | 0.75 | 1 |
| SLCO1B1 AND SLC12A9 | Liver | 0.857143 | 0.75 | 1 |
| SLCO1B1 AND RGSL1 | Liver | 0.769231 | 0.714286 | 0.833333 |
| SLCO1B1 AND SLC6A11 | Liver | 0.8 | 1 | 0.666667 |
| SLCO1B1 AND MMP24 | Liver | 0.833333 | 0.833333 | 0.833333 |
| SLC2A2 AND TSHR | Liver | 0.769231 | 0.714286 | 0.833333 |
| ABCG8 AND ALCAM | Liver | 0.8 | 1 | 0.666667 |
| SLC17A2 AND NPFFR1 | Liver | 0.8 | 1 | 0.666667 |
| SLCO1B1 AND SLC22A11 | Liver | 0.833333 | 0.833333 | 0.833333 |
| SLC2A2 AND NKAIN4 | Liver | 0.8 | 1 | 0.666667 |
| SLCO1B1 AND CALN1 | Liver | 0.8 | 0.666667 | 1 |
| SLCO1B1 AND DRD5 | Liver | 0.75 | 0.6 | 1 |
| SLCO1B1 AND OPCML | Liver | 0.75 | 0.6 | 1 |
| SLC2A2 AND ACSL6 | Liver | 1 | 1 | 1 |
| SLCO1B1 AND NKAIN4 | Liver | 0.8 | 1 | 0.666667 |
| SLC17A2 AND ALCAM | Liver | 0.909091 | 1 | 0.833333 |
| SLC17A2 AND DTNA | Liver | 0.909091 | 1 | 0.833333 |
| SLCO1B1 AND MAG | Liver | 0.769231 | 0.714286 | 0.833333 |
| C8B AND SMPD2 | Liver | 0.8 | 1 | 0.666667 |
| SLCO1B1 AND TRPM3 | Liver | 0.833333 | 0.833333 | 0.833333 |
| SLCO1B1 AND SCN2A | Liver | 0.769231 | 0.714286 | 0.833333 |

| Antigen Pair Logic | Cancer (short name) | F1 | Precision | Recall |
|---|---|---|---|---|
| FAP AND SDC1 | Breast | 0.875 | 1 | 0.777778 |
| FAP AND WT1 | Breast | 0.808081 | 0.888889 | 0.740741 |
| FAP AND MS4A1 | Breast | 0.744681 | 0.875 | 0.648148 |
| FAP AND SLC7A5 | Breast | 0.868687 | 0.955556 | 0.796296 |
| FAP AND FOLH1 | Breast | 0.828283 | 0.911111 | 0.759259 |
| FAP AND CLDN7 | Breast | 0.698795 | 1 | 0.537037 |
| FAP AND BIRC5 | Breast | 0.82 | 0.891304 | 0.759259 |
| FAP AND SSTR4 | Breast | 0.744681 | 0.875 | 0.648148 |
| FAP AND RNF43 | Breast | 0.857143 | 0.954545 | 0.777778 |
| FAP AND CD22 | Breast | 0.757895 | 0.878049 | 0.666667 |
| TPBG AND FAP | Breast | 0.705882 | 0.967742 | 0.555556 |
| FAP AND CXCR5 | Breast | 0.755102 | 0.840909 | 0.685185 |
| VTCN1 AND VCAM1 | Breast | 0.690476 | 0.966667 | 0.537037 |
| FAP AND BCAN | Breast | 0.723404 | 0.85 | 0.62963 |
| VTCN1 AND KDR | Breast | 0.690476 | 0.966667 | 0.537037 |
| FAP AND MUC13 | Breast | 0.795918 | 0.886364 | 0.722222 |
| VTCN1 AND GPNMB | Breast | 0.690476 | 0.966667 | 0.537037 |
| VTCN1 AND THY1 | Breast | 0.682927 | 1 | 0.518519 |
| VTCN1 AND SLC7A5 | Breast | 0.682927 | 1 | 0.518519 |
| FAP AND CD70 | Breast | 0.816327 | 0.909091 | 0.740741 |
| FAP AND MUC4 | Breast | 0.681319 | 0.837838 | 0.574074 |
| FAP AND SLAMF7 | Breast | 0.782609 | 0.947368 | 0.666667 |
| VTCN1 AND CD34 | Breast | 0.674699 | 0.965517 | 0.518519 |
| FAP AND DNAJB8 | Breast | 0.674157 | 0.857143 | 0.555556 |
| TPBG AND CLDN4 | Breast | 0.674157 | 0.857143 | 0.555556 |
| CLDN2 AND CD276 | Liver | 0.909091 | 1 | 0.833333 |
| CLDN2 AND CD70 | Liver | 0.769231 | 0.714286 | 0.833333 |
| CLDN2 AND SDC1 | Liver | 0.8 | 1 | 0.666667 |
| CLDN2 AND CLDN1 | Liver | 0.8 | 1 | 0.666667 |
| CLDN2 AND IL11RA | Liver | 0.615385 | 0.571429 | 0.666667 |
| FAP AND EPCAM | Pancreas | 0.777778 | 1 | 0.636364 |
| FAP AND CLDN7 | Pancreas | 0.842105 | 1 | 0.727273 |
| FAP AND ITGB6 | Pancreas | 0.777778 | 1 | 0.636364 |
| FAP AND PROM1 | Pancreas | 0.777778 | 1 | 0.636364 |
| FAP AND MUC13 | Pancreas | 0.705882 | 1 | 0.545455 |
| FAP AND ERBB3 | Pancreas | 0.842105 | 1 | 0.727273 |
| FAP AND CLDN18 | Pancreas | 0.625 | 1 | 0.454545 |
| FAP AND CD79A | Pancreas | 0.705882 | 1 | 0.545455 |
| FAP AND CD52 | Pancreas | 0.777778 | 1 | 0.636364 |
| FAP AND FCRL5 | Pancreas | 0.842105 | 1 | 0.727273 |
| FAP AND CD37 | Pancreas | 0.705882 | 1 | 0.545455 |
| FAP AND MST1R | Pancreas | 0.705882 | 1 | 0.545455 |
| FAP AND VCAM1 | Pancreas | 0.777778 | 1 | 0.636364 |
| FAP AND CLDN23 | Pancreas | 0.777778 | 1 | 0.636364 |
| FAP AND SLAMF7 | Pancreas | 0.705882 | 1 | 0.545455 |
| FAP AND STEAP1 | Pancreas | 0.777778 | 1 | 0.636364 |
| FAP AND TNFSF11 | Pancreas | 0.842105 | 1 | 0.727273 |
| FAP AND TNFRSF17 | Pancreas | 0.842105 | 1 | 0.727273 |
| FAP AND SDC1 | Pancreas | 0.705882 | 1 | 0.545455 |
| FAP AND IGF1R | Pancreas | 0.842105 | 1 | 0.727273 |
| FAP AND TNFRSF10A | Pancreas | 0.777778 | 1 | 0.636364 |
| FAP AND FOLH1 | Pancreas | 0.842105 | 1 | 0.727273 |
| CLDN2 AND GPNMB | Pancreas | 0.842105 | 1 | 0.727273 |
| FAP AND SLC7A5 | Pancreas | 0.842105 | 1 | 0.727273 |
| FAP AND MUC4 | Pancreas | 0.777778 | 1 | 0.636364 |
| EPHA3 AND MUC13 | Pancreas | 0.631579 | 0.75 | 0.545455 |
| FAP AND CD72 | Pancreas | 0.777778 | 1 | 0.636364 |
| FAP AND CD38 | Pancreas | 0.777778 | 1 | 0.636364 |
| FAP AND FOLR1 | Pancreas | 0.777778 | 1 | 0.636364 |
| FAP AND ULBP1 | Pancreas | 0.777778 | 1 | 0.636364 |
| FAP AND STEAP2 | Pancreas | 0.777778 | 1 | 0.636364 |
| FAP AND CLDN2 | Pancreas | 0.842105 | 1 | 0.727273 |
| FAP AND IL2RA | Pancreas | 0.705882 | 1 | 0.545455 |
| FAP AND BMPR1B | Pancreas | 0.777778 | 1 | 0.636364 |
| FAP AND EPHB2 | Pancreas | 0.842105 | 1 | 0.727273 |
| EPHA3 AND CLDN1 | Pancreas | 0.625 | 1 | 0.454545 |
| EPHA3 AND CLDN2 | Pancreas | 0.705882 | 1 | 0.545455 |
| FAP AND RNF43 | Pancreas | 0.777778 | 1 | 0.636364 |
| EPHA3 AND CD70 | Pancreas | 0.631579 | 0.75 | 0.545455 |
| EPHA3 AND PROM1 | Pancreas | 0.625 | 1 | 0.454545 |
| FAP AND VTCN1 | Pancreas | 0.777778 | 1 | 0.636364 |
| EPHA3 AND CD52 | Pancreas | 0.736842 | 0.875 | 0.636364 |
| TNFSF11 AND CLDN18 | Pancreas | 0.625 | 1 | 0.454545 |
| EPHA3 AND IL13RA1 | Pancreas | 0.705882 | 1 | 0.545455 |
| EPHA3 AND TNFSF11 | Pancreas | 0.666667 | 0.857143 | 0.545455 |
| FAP AND IL13RA1 | Pancreas | 0.842105 | 1 | 0.727273 |
| FAP AND TRPM4 | Pancreas | 0.705882 | 1 | 0.545455 |

FIG. 8 (Cont.)

| Antigen Pair Logic | Cancer (short name) | F1 | Precision | Recall |
|---|---|---|---|---|
| SLC2A2 AND PCDHAC2 | Liver | 0.833333 | 0.833333 | 0.833333 |
| SLC2A2 AND CACNG1 | Liver | 0.769231 | 0.714286 | 0.833333 |
| SLC17A2 AND KCNJ6 | Liver | 0.8 | 1 | 0.666667 |
| SLCO1B1 AND GRM1 | Liver | 0.8 | 0.666667 | 1 |
| SLC2A2 AND LRRN4 | Liver | 0.8 | 1 | 0.666667 |
| SLC13A5 AND ZACN | Liver | 0.833333 | 0.833333 | 0.833333 |
| SLC2A2 AND CRB2 | Liver | 0.769231 | 0.714286 | 0.833333 |
| SLC2A2 AND OR7C1 | Liver | 0.769231 | 0.714286 | 0.833333 |
| SLC2A2 AND GABRA3 | Liver | 0.909091 | 1 | 0.833333 |
| SLC2A2 AND MMP24 | Liver | 0.833333 | 0.833333 | 0.833333 |
| SLCO1B1 AND UPK3A | Liver | 0.727273 | 0.8 | 0.666667 |
| SLCO1B1 AND MLANA | Liver | 0.727273 | 0.8 | 0.666667 |
| SLC2A2 AND KCNA7 | Liver | 0.727273 | 0.8 | 0.666667 |
| SLC17A2 AND FGF6 | Liver | 0.727273 | 0.8 | 0.666667 |
| SLC2A2 AND HCN1 | Liver | 0.727273 | 0.8 | 0.666667 |
| SLCO1B1 AND GABRA5 | Liver | 0.857143 | 0.75 | 1 |
| SLC2A2 AND OR8D1 | Liver | 0.769231 | 0.714286 | 0.833333 |
| SLCO1B1 AND LRRN4 | Liver | 0.8 | 1 | 0.666667 |
| SLCO1B1 AND GPR61 | Liver | 0.909091 | 1 | 0.833333 |
| SLC2A2 AND DPP10 | Liver | 0.727273 | 0.8 | 0.666667 |
| SLC2A2 AND MLANA | Liver | 0.727273 | 0.8 | 0.666667 |
| SLC30A8 AND HLA-DRB1 | Pancreas | 0.777778 | 1 | 0.636364 |
| CLDN10 AND BST2 | Pancreas | 0.625 | 1 | 0.454545 |
| SLC30A8 AND BST2 | Pancreas | 0.777778 | 1 | 0.636364 |
| PPAPDC1A AND CD58 | Pancreas | 0.705882 | 1 | 0.545455 |
| SLC30A8 AND LAPTM5 | Pancreas | 0.777778 | 1 | 0.636364 |
| SLC22A2 AND HLA-DRB1 | Renal | 0.7 | 0.875 | 0.583333 |
| SLC17A1 AND IFNAR2 | Renal | 0.666667 | 1 | 0.5 |
| SLC6A13 AND HLA-DRB1 | Renal | 0.631579 | 0.857143 | 0.5 |
| SLC22A2 AND VAMP8 | Renal | 0.631579 | 0.857143 | 0.5 |
| SLC13A1 AND EMP3 | Renal | 0.6 | 0.75 | 0.5 |
| SLC17A1 AND HLA-DRB1 | Renal | 0.631579 | 0.857143 | 0.5 |
| SLC17A1 AND CXCL16 | Renal | 0.666667 | 1 | 0.5 |
| NOX1 AND TGFBI | Colon | 0.909091 | 0.833333 | 1 |
| FUT3 AND TGFBI | Colon | 0.909091 | 0.833333 | 1 |
| IFI6 AND NOX1 | Colon | 1 | 1 | 1 |
| IFI6 AND FUT3 | Colon | 1 | 1 | 1 |
| CDH17 AND TGFBI | Colon | 0.909091 | 0.833333 | 1 |
| IFI6 AND FAT1 | Colon | 0.888889 | 1 | 0.8 |
| IFI6 AND CDH17 | Colon | 0.888889 | 1 | 0.8 |
| IFI6 AND CEACAM7 | Colon | 1 | 1 | 1 |
| IFI6 AND MUC12 | Colon | 1 | 1 | 1 |
| MUC12 AND TGFBI | Colon | 0.909091 | 0.833333 | 1 |
| IFI6 AND EBP | Colon | 0.909091 | 0.833333 | 1 |
| IFI6 AND SLC22A18 | Colon | 0.75 | 1 | 0.6 |
| IFI6 AND SLC50A1 | Colon | 0.727273 | 0.666667 | 0.8 |
| IFI6 AND LRIG3 | Colon | 0.8 | 0.8 | 0.8 |
| IFI6 AND VANGL1 | Colon | 0.909091 | 0.833333 | 1 |
| CDH17 AND PPAPDC1A | Colon | 0.75 | 1 | 0.6 |
| CDH17 AND BST2 | Colon | 0.75 | 1 | 0.6 |
| IFI6 AND ATP8B1 | Colon | 0.888889 | 1 | 0.8 |
| CDH17 AND CDH11 | Colon | 0.75 | 1 | 0.6 |
| SLC22A18 AND TGFBI | Colon | 0.666667 | 0.75 | 0.6 |
| CLDN15 AND TGFBI | Colon | 0.666667 | 0.75 | 0.6 |
| IFI6 AND CLDN15 | Colon | 0.75 | 1 | 0.6 |
| IFI6 AND PAQR8 | Colon | 0.8 | 0.8 | 0.8 |
| IFI6 AND EFNB2 | Colon | 0.888889 | 1 | 0.8 |
| IFI6 AND PPAPDC1A | Colon | 0.888889 | 1 | 0.8 |
| IFI6 AND SLC1A5 | Colon | 0.888889 | 1 | 0.8 |
| SLC22A18 AND CDH11 | Colon | 0.75 | 1 | 0.6 |
| CEACAM7 AND TGFBI | Colon | 0.909091 | 0.833333 | 1 |
| IFI6 AND FLVCR1 | Colon | 0.833333 | 0.714286 | 1 |
| GRIN2A AND TGFBI | Ependymoma | 1 | 1 | 1 |
| CXCL16 AND CDH17 | Esophagus | 0.666667 | 0.692308 | 0.642857 |
| CXCL16 AND FUT3 | Esophagus | 0.782609 | 1 | 0.642857 |
| SLCO1B3 AND VANGL1 | Esophagus | 0.636364 | 0.875 | 0.5 |
| CXCL16 AND MUC17 | Esophagus | 0.782609 | 1 | 0.642857 |
| SLCO1B3 AND SLC6A6 | Esophagus | 0.636364 | 0.875 | 0.5 |
| SLCO1B3 AND LRIG3 | Esophagus | 0.636364 | 0.875 | 0.5 |
| GPR158 AND F2R | Glioblastoma | 0.83871 | 0.928571 | 0.764706 |
| LYPD1 AND LAPTM5 | Glioblastoma | 0.903226 | 1 | 0.823529 |
| LYPD1 AND ADAM29 | Glioblastoma | 0.777778 | 0.736842 | 0.823529 |
| LYPD1 AND HLA-DRB1 | Glioblastoma | 0.777778 | 0.736842 | 0.823529 |
| CRB1 AND CD58 | Glioblastoma | 0.758621 | 0.916667 | 0.647059 |
| LYPD1 AND SPAM1 | Glioblastoma | 0.742857 | 0.722222 | 0.764706 |
| LYPD1 AND F2R | Glioblastoma | 0.740741 | 1 | 0.588235 |
| MLC1 AND BTN3A3 | Glioblastoma | 0.736842 | 0.666667 | 0.823529 |

| Antigen Pair Logic | Cancer (short name) | F1 | Precision | Recall |
|---|---|---|---|---|
| FAP AND MS4A1 | Pancreas | 0.705882 | 1 | 0.545455 |
| FAP AND EGFR | Pancreas | 0.842105 | 1 | 0.727273 |
| FAP AND MET | Pancreas | 0.705882 | 1 | 0.545455 |
| CLDN2 AND FCRL5 | Pancreas | 0.666667 | 0.5625 | 0.818182 |
| FAP AND GUCY2C | Pancreas | 0.842105 | 1 | 0.727273 |
| EPHA3 AND STEAP1 | Pancreas | 0.666667 | 0.857143 | 0.545455 |
| FAP AND FCRL2 | Pancreas | 0.842105 | 1 | 0.727273 |
| EPHA3 AND STEAP2 | Pancreas | 0.6 | 0.666667 | 0.545455 |
| FAP AND FCRL1 | Pancreas | 0.842105 | 1 | 0.727273 |
| FAP AND CLDN12 | Pancreas | 0.777778 | 1 | 0.636364 |
| EPHA3 AND EPHB2 | Pancreas | 0.7 | 0.777778 | 0.636364 |
| FAP AND SSTR5 | Pancreas | 0.705882 | 1 | 0.545455 |
| FAP AND SLC34A2 | Pancreas | 0.777778 | 1 | 0.636364 |
| FAP AND CLDN1 | Pancreas | 0.777778 | 1 | 0.636364 |
| FAP AND MUC16 | Pancreas | 0.842105 | 1 | 0.727273 |
| FAP AND LGR5 | Pancreas | 0.842105 | 1 | 0.727273 |
| EPHA3 AND CD72 | Pancreas | 0.666667 | 0.7 | 0.636364 |
| EPHA3 AND IL2RA | Pancreas | 0.608696 | 0.583333 | 0.636364 |
| FAP AND GPA33 | Pancreas | 0.842105 | 1 | 0.727273 |
| CLDN2 AND VCAM1 | Renal | 0.761905 | 0.888889 | 0.666667 |
| VCAM1 AND ERBB3 | Renal | 0.736842 | 1 | 0.583333 |
| CLDN2 AND GPNMB | Renal | 0.695652 | 0.727273 | 0.666667 |
| CLDN2 AND CD276 | Renal | 0.695652 | 0.727273 | 0.666667 |
| CLDN2 AND AXL | Renal | 0.761905 | 0.888889 | 0.666667 |
| VCAM1 AND EPCAM | Renal | 0.666667 | 1 | 0.5 |
| VCAM1 AND FOLR1 | Renal | 0.857143 | 1 | 0.75 |
| VCAM1 AND ERBB2 | Renal | 0.666667 | 1 | 0.5 |
| VCAM1 AND MUC1 | Renal | 0.666667 | 1 | 0.5 |
| VCAM1 AND CLDN12 | Renal | 0.8 | 1 | 0.666667 |
| VCAM1 AND ABCB5 | Renal | 0.666667 | 0.6 | 0.75 |
| VCAM1 AND SDC1 | Renal | 0.8 | 1 | 0.666667 |
| VCAM1 AND CLDN1 | Renal | 0.857143 | 1 | 0.75 |
| VCAM1 AND EGFR | Renal | 0.736842 | 1 | 0.583333 |
| DPEP1 AND ITGAV | Colon | 0.909091 | 0.833333 | 1 |
| DPEP1 AND CEACAM6 | Colon | 1 | 1 | 1 |
| GPA33 AND CLDN1 | Colon | 1 | 1 | 1 |
| CEACAM5 AND THY1 | Colon | 0.888889 | 1 | 0.8 |
| DPEP1 AND CBX3 | Colon | 0.888889 | 1 | 0.8 |
| DPEP1 AND BIRC5 | Colon | 1 | 1 | 1 |
| GUCY2C AND CLDN1 | Colon | 1 | 1 | 1 |
| MUC13 AND THY1 | Colon | 1 | 1 | 1 |
| MUC13 AND CLDN1 | Colon | 1 | 1 | 1 |
| GUCY2C AND THY1 | Colon | 1 | 1 | 1 |
| GPA33 AND THY1 | Colon | 1 | 1 | 1 |
| EPHB2 AND ITGAV | Colon | 0.888889 | 1 | 0.8 |
| DPEP1 AND SLC7A5 | Colon | 0.909091 | 0.833333 | 1 |
| CLDN3 AND THY1 | Colon | 1 | 1 | 1 |
| MUC13 AND SLC7A5 | Colon | 1 | 1 | 1 |
| GUCY2C AND SLC7A5 | Colon | 1 | 1 | 1 |
| GPA33 AND SLC7A5 | Colon | 1 | 1 | 1 |
| CEACAM6 AND THY1 | Colon | 0.888889 | 1 | 0.8 |
| DPEP1 AND STEAP1 | Colon | 0.888889 | 1 | 0.8 |
| CLDN7 AND THY1 | Colon | 1 | 1 | 1 |
| CLDN3 AND SLC7A5 | Colon | 1 | 1 | 1 |
| CLDN3 AND ITGAV | Colon | 0.909091 | 0.833333 | 1 |
| CLDN2 AND ITGAV | Colon | 0.8 | 0.8 | 0.8 |
| CEACAM5 AND FAP | Colon | 0.888889 | 1 | 0.8 |
| CLDN2 AND CEACAM6 | Colon | 0.888889 | 1 | 0.8 |
| GUCY2C AND ITGAV | Colon | 1 | 1 | 1 |
| EPHB2 AND THY1 | Colon | 0.888889 | 1 | 0.8 |
| MUC13 AND FAP | Colon | 0.888889 | 1 | 0.8 |
| CEACAM6 AND FAP | Colon | 0.888889 | 1 | 0.8 |
| CLDN2 AND BIRC5 | Colon | 0.888889 | 1 | 0.8 |
| GUCY2C AND FAP | Colon | 0.888889 | 1 | 0.8 |
| EPHB2 AND CLDN1 | Colon | 0.888889 | 1 | 0.8 |
| DPEP1 AND EPHB2 | Colon | 0.888889 | 1 | 0.8 |
| GPA33 AND FAP | Colon | 0.888889 | 1 | 0.8 |
| EPHB2 AND FAP | Colon | 0.888889 | 1 | 0.8 |
| CLDN2 AND LGR5 | Colon | 0.888889 | 1 | 0.8 |
| RNF43 AND CEACAM5 | Colon | 0.75 | 1 | 0.6 |
| RNF43 AND CEACAM6 | Colon | 0.75 | 1 | 0.6 |
| DPEP1 AND IL20RA | Colon | 0.888889 | 1 | 0.8 |
| CLDN7 AND ITGAV | Colon | 1 | 1 | 1 |
| GPA33 AND ITGAV | Colon | 1 | 1 | 1 |
| MUC13 AND ITGAV | Colon | 1 | 1 | 1 |
| DPEP1 AND LGR5 | Colon | 0.888889 | 1 | 0.8 |
| CLDN7 AND FAP | Colon | 0.888889 | 1 | 0.8 |

FIG. 8 (Cont.)

| Antigen Pair Logic | Cancer (short name) | F1 | Precision | Recall |
|---|---|---|---|---|
| SLCO1C1 AND LAPTM5 | Glioblastoma | 0.823529 | 0.823529 | 0.823529 |
| SLCO1C1 AND TNFRSF12A | Glioblastoma | 0.733333 | 0.846154 | 0.647059 |
| SLCO1C1 AND ANTXR2 | Glioblastoma | 0.727273 | 0.75 | 0.705882 |
| LYPD1 AND ANTXR2 | Glioblastoma | 0.740741 | 1 | 0.588235 |
| CDH10 AND STAB1 | Glioblastoma | 0.758621 | 0.916667 | 0.647059 |
| LYPD1 AND CD44 | Glioblastoma | 0.758621 | 0.916667 | 0.647059 |
| LYPD1 AND CD163 | Glioblastoma | 0.903226 | 1 | 0.823529 |
| CDH10 AND LAPTM5 | Glioblastoma | 0.810811 | 0.75 | 0.882353 |
| MLC1 AND BST2 | Glioblastoma | 0.736842 | 0.666667 | 0.823529 |
| LYPD1 AND CD93 | Glioblastoma | 0.785714 | 1 | 0.647059 |
| LYPD1 AND TGFBI | Glioblastoma | 0.8 | 0.923077 | 0.705882 |
| LYPD1 AND TNFRSF12A | Glioblastoma | 0.714286 | 0.909091 | 0.588235 |
| CDH10 AND ANTXR2 | Glioblastoma | 0.785714 | 1 | 0.647059 |
| SLCO1C1 AND CD93 | Glioblastoma | 0.727273 | 0.75 | 0.705882 |
| ASTN1 AND EMP3 | Glioblastoma | 0.709677 | 0.785714 | 0.647059 |
| MLC1 AND TNFRSF12A | Glioblastoma | 0.709677 | 0.785714 | 0.647059 |
| CRB1 AND LAPTM5 | Glioblastoma | 0.709677 | 0.785714 | 0.647059 |
| LYPD1 AND CXCL16 | Glioblastoma | 0.827586 | 1 | 0.705882 |
| SLCO1C1 AND CD58 | Glioblastoma | 0.787879 | 0.8125 | 0.764706 |
| LYPD1 AND CDH11 | Glioblastoma | 0.83871 | 0.928571 | 0.764706 |
| LYPD1 AND VAMP8 | Glioblastoma | 0.777778 | 0.736842 | 0.823529 |
| SYT11 AND TNFRSF12A | Glioblastoma | 0.705882 | 0.705882 | 0.705882 |
| SLCO1C1 AND CDH11 | Glioblastoma | 0.714286 | 0.6 | 0.882353 |
| LYPD1 AND OR1C1 | Glioblastoma | 0.702703 | 0.65 | 0.764706 |
| LYPD1 AND SLCO1B3 | Glioblastoma | 0.736842 | 0.666667 | 0.823529 |
| GPR158 AND SLC39A8 | Glioblastoma | 0.733333 | 0.846154 | 0.647059 |
| PCDH8 AND LAPTM5 | Glioblastoma | 0.8125 | 0.866667 | 0.764706 |
| LYPD1 AND BST2 | Glioblastoma | 0.875 | 0.933333 | 0.823529 |
| LYPD1 AND DTNA | Glioblastoma | 0.7 | 0.608696 | 0.823529 |
| LYPD1 AND KCNJ10 | Glioblastoma | 0.7 | 0.608696 | 0.823529 |
| ASTN1 AND CD58 | Glioblastoma | 0.733333 | 0.846154 | 0.647059 |
| LYPD1 AND SYT11 | Glioblastoma | 0.7 | 0.608696 | 0.823529 |
| CDH10 AND EMP3 | Glioblastoma | 0.785714 | 1 | 0.647059 |
| LYPD1 AND CD58 | Glioblastoma | 0.692308 | 1 | 0.529412 |
| LYPD1 AND EMP3 | Glioblastoma | 0.692308 | 1 | 0.529412 |
| GPR158 AND CD163 | Glioblastoma | 0.764706 | 0.764706 | 0.764706 |
| CRB1 AND BTN3A1 | Glioblastoma | 0.689655 | 0.833333 | 0.588235 |
| CDH10 AND TNFRSF12A | Glioblastoma | 0.689655 | 0.833333 | 0.588235 |
| LYPD1 AND STAB1 | Glioblastoma | 0.689655 | 0.833333 | 0.588235 |
| SLC1A2 AND BST2 | Glioblastoma | 0.689655 | 0.833333 | 0.588235 |
| OMG AND F2R | Glioblastoma | 0.6875 | 0.733333 | 0.647059 |
| SLCO1C1 AND STAB1 | Glioblastoma | 0.6875 | 0.733333 | 0.647059 |
| ASTN1 AND ANTXR2 | Glioblastoma | 0.6875 | 0.733333 | 0.647059 |
| LYPD1 AND BTN3A3 | Glioblastoma | 0.689655 | 0.833333 | 0.588235 |
| GPR158 AND CD93 | Glioblastoma | 0.684211 | 0.619048 | 0.764706 |
| LYPD1 AND SLCO1C1 | Glioblastoma | 0.682927 | 0.583333 | 0.823529 |
| LYPD1 AND CDH10 | Glioblastoma | 0.682927 | 0.583333 | 0.823529 |
| SLCO1C1 AND SLC39A8 | Glioblastoma | 0.733333 | 0.846154 | 0.647059 |
| SLCO1C1 AND CD163 | Glioblastoma | 0.774194 | 0.857143 | 0.705882 |
| CDH10 AND VAMP8 | Glioblastoma | 0.714286 | 0.6 | 0.882353 |
| ASTN1 AND CD93 | Glioblastoma | 0.666667 | 0.6875 | 0.647059 |
| CRB1 AND BST2 | Glioblastoma | 0.666667 | 0.6875 | 0.647059 |
| SLCO1C1 AND VAMP8 | Glioblastoma | 0.666667 | 0.535714 | 0.882353 |
| GABBR2 AND LAPTM5 | Glioblastoma | 0.666667 | 0.590909 | 0.764706 |
| SLC1A2 AND LAPTM5 | Glioblastoma | 0.666667 | 0.769231 | 0.588235 |
| CRB1 AND SLC31A1 | Glioblastoma | 0.666667 | 0.9 | 0.529412 |
| CRB1 AND CXCL16 | Glioblastoma | 0.666667 | 0.769231 | 0.588235 |
| CDH10 AND CDH11 | Glioblastoma | 0.848485 | 0.875 | 0.823529 |
| MLC1 AND SLC31A1 | Glioblastoma | 0.666667 | 0.631579 | 0.705882 |
| SLCO1C1 AND TGFBI | Glioblastoma | 0.666667 | 0.590909 | 0.764706 |
| CRB1 AND F2R | Glioblastoma | 0.666667 | 0.9 | 0.529412 |
| LYPD1 AND TTYH2 | Glioblastoma | 0.666667 | 0.590909 | 0.764706 |
| MLC1 AND F2R | Glioblastoma | 0.666667 | 0.631579 | 0.705882 |
| LYPD1 AND KCNA2 | Glioblastoma | 0.666667 | 0.590909 | 0.764706 |
| SLC1A2 AND CD163 | Glioblastoma | 0.666667 | 0.769231 | 0.588235 |
| CRB1 AND CDH11 | Glioblastoma | 0.666667 | 0.6875 | 0.647059 |
| LYPD1 AND DSCAM | Glioblastoma | 0.666667 | 0.56 | 0.823529 |
| SYT11 AND F2R | Glioma | 0.992701 | 1 | 0.985507 |
| GPR158 AND F2R | Glioma | 0.977778 | 1 | 0.956522 |
| SYT11 AND BTN3A3 | Glioma | 0.933333 | 0.954545 | 0.913043 |
| SYT11 AND HLA-DRB1 | Glioma | 0.934307 | 0.941176 | 0.927536 |
| SYT11 AND LAPTM5 | Glioma | 0.971429 | 0.957746 | 0.985507 |
| SYT11 AND VAMP8 | Glioma | 0.948905 | 0.955882 | 0.942029 |
| SYT11 AND STAB1 | Glioma | 0.964539 | 0.944444 | 0.985507 |
| SYT11 AND CD74 | Glioma | 0.957143 | 0.943662 | 0.971014 |
| OMG AND F2R | Glioma | 0.9 | 0.887324 | 0.913043 |
| SYT11 AND CLDN15 | Glioma | 0.978417 | 0.971429 | 0.985507 |

| Antigen Pair Logic | Cancer (short name) | F1 | Precision | Recall |
|---|---|---|---|---|
| CLDN2 AND FAP | Colon | 0.888889 | 1 | 0.8 |
| CLDN3 AND FAP | Colon | 0.888889 | 1 | 0.8 |
| CLDN2 AND IL20RA | Colon | 0.888889 | 1 | 0.8 |
| CLDN2 AND EPHB2 | Colon | 0.888889 | 1 | 0.8 |
| EPCAM AND SLC7A5 | Esophagus | 0.8125 | 0.722222 | 0.928571 |
| EPCAM AND ITGAV | Esophagus | 0.692308 | 0.75 | 0.642857 |
| CBX3 AND EPCAM | Esophagus | 0.666667 | 0.8 | 0.571429 |
| EPCAM AND SDC1 | Esophagus | 0.88 | 1 | 0.785714 |
| CBX3 AND MUC1 | Esophagus | 0.608696 | 0.777778 | 0.5 |
| CBX3 AND ERBB3 | Esophagus | 0.666667 | 0.8 | 0.571429 |
| CBX3 AND CLDN7 | Esophagus | 0.666667 | 0.8 | 0.571429 |
| CBX3 AND RNF43 | Esophagus | 0.608696 | 0.777778 | 0.5 |
| CBX3 AND CLDN1 | Esophagus | 0.666667 | 1 | 0.5 |
| MUC13 AND SLC7A5 | Esophagus | 0.923077 | 1 | 0.857143 |
| CBX3 AND EGFR | Esophagus | 0.64 | 0.727273 | 0.571429 |
| CBX3 AND ITGB6 | Esophagus | 0.666667 | 0.8 | 0.571429 |
| MUC13 AND THY1 | Esophagus | 0.857143 | 0.857143 | 0.857143 |
| CBX3 AND CLDN4 | Esophagus | 0.666667 | 0.8 | 0.571429 |
| CBX3 AND CLDN12 | Esophagus | 0.64 | 0.727273 | 0.571429 |
| CBX3 AND KDR | Esophagus | 0.615385 | 0.666667 | 0.571429 |
| CBX3 AND IL20RA | Esophagus | 0.666667 | 0.8 | 0.571429 |
| EPHB2 AND CLDN1 | Esophagus | 0.923077 | 1 | 0.857143 |
| CBX3 AND MUC13 | Esophagus | 0.608696 | 0.777778 | 0.5 |
| BIRC5 AND EPCAM | Esophagus | 0.782609 | 1 | 0.642857 |
| EPHB2 AND SLC7A5 | Esophagus | 0.8 | 0.75 | 0.857143 |
| ITGAV AND CLDN3 | Esophagus | 0.608696 | 0.777778 | 0.5 |
| CEACAM5 AND THY1 | Esophagus | 0.896552 | 0.866667 | 0.928571 |
| CBX3 AND CLDN3 | Esophagus | 0.666667 | 0.8 | 0.571429 |
| BMPR1B AND ITGAV | Glioblastoma | 0.702703 | 0.65 | 0.764706 |
| NCAM1 AND SLC39A6 | Glioma | 0.829268 | 0.944444 | 0.73913 |
| NCAM1 AND ITGAV | Glioma | 0.784314 | 0.714286 | 0.869565 |
| ITGAV AND BMPR1B | Glioma | 0.859259 | 0.878788 | 0.84058 |
| ITGAV AND SLC7A5 | Glioma | 0.925373 | 0.953846 | 0.898551 |
| NCAM1 AND IL13RA1 | Glioma | 0.753623 | 0.753623 | 0.753623 |
| ITGAV AND ULBP1 | Glioma | 0.859259 | 0.878788 | 0.84058 |
| ITGAV AND SLC39A6 | Glioma | 0.868852 | 1 | 0.768116 |
| NCAM1 AND EDNRB | Glioma | 0.716418 | 0.738462 | 0.695652 |
| ITGAV AND ERBB4 | Glioma | 0.817518 | 0.823529 | 0.811594 |
| NCAM1 AND CD276 | Glioma | 0.71345 | 0.598039 | 0.884058 |
| ITGAV AND EDNRB | Glioma | 0.8 | 0.941176 | 0.695652 |
| NCAM1 AND PROM1 | Glioma | 0.717557 | 0.758065 | 0.681159 |
| NCAM1 AND CLDN12 | Glioma | 0.702703 | 0.928571 | 0.565217 |
| ITGAV AND CD19 | Glioma | 0.834532 | 0.828571 | 0.84058 |
| ITGAV AND GUCY2C | Glioma | 0.884058 | 0.884058 | 0.884058 |
| ITGAV AND CLDN12 | Glioma | 0.809917 | 0.942308 | 0.710145 |
| ITGAV AND CR2 | Glioma | 0.884058 | 0.884058 | 0.884058 |
| ITGAV AND MSLN | Glioma | 0.916667 | 0.88 | 0.956522 |
| ITGAV AND SSTR4 | Glioma | 0.884058 | 0.884058 | 0.884058 |
| ITGAV AND L1CAM | Glioma | 0.907801 | 0.888889 | 0.927536 |
| ITGAV AND FCRL5 | Glioma | 0.833333 | 0.873016 | 0.797101 |
| ITGAV AND FCRL1 | Glioma | 0.9 | 0.887324 | 0.913043 |
| CD37 AND SLC7A5 | AML | 0.818505 | 0.73955 | 0.916335 |
| CD38 AND SLC7A5 | AML | 0.776291 | 0.746324 | 0.808765 |
| CD37 AND MUC1 | AML | 0.725173 | 0.862637 | 0.625498 |
| P2RX5 AND SLC7A5 | AML | 0.683465 | 0.565104 | 0.864542 |
| CD38 AND CD70 | AML | 0.666667 | 0.664032 | 0.669323 |
| P2RX5 AND CD70 | AML | 0.649266 | 0.549724 | 0.792829 |
| SLC7A5 AND CD70 | AML | 0.648464 | 0.567164 | 0.756972 |
| SLC7A5 AND CD52 | AML | 0.755556 | 0.627968 | 0.948207 |
| CD38 AND PROM1 | AML | 0.64466 | 0.628788 | 0.661355 |
| CD276 AND EPHB2 | Liposarcoma | 0.779221 | 0.731707 | 0.833333 |
| EPHB2 AND GPNMB | Liposarcoma | 0.716049 | 0.644444 | 0.805556 |
| CD276 AND FOLH1 | Liposarcoma | 0.712329 | 0.702703 | 0.722222 |
| EPHB2 AND ENG | Liposarcoma | 0.704545 | 0.596154 | 0.861111 |
| EPHB2 AND PTK7 | Liposarcoma | 0.736842 | 0.7 | 0.777778 |
| CD276 AND B4GALNT1 | Liposarcoma | 0.622951 | 0.76 | 0.527778 |
| EPHB2 AND FOLH1 | Liposarcoma | 0.638298 | 0.517241 | 0.833333 |
| CD276 AND MS4A1 | Liposarcoma | 0.652174 | 0.535714 | 0.833333 |
| SLC34A2 AND SLC7A5 | Lung Adenocarcinoma | 0.666667 | 0.636364 | 0.7 |
| SLC34A2 AND FCRL5 | Lung Adenocarcinoma | 0.639344 | 0.75 | 0.557143 |
| EPCAM AND SLC7A5 | Lung Adenocarcinoma | 0.632479 | 0.787234 | 0.528571 |
| FAP AND EPCAM | Lung Adenocarcinoma | 0.625 | 0.833333 | 0.5 |
| FAP AND CEACAM6 | Lung Adenocarcinoma | 0.634615 | 0.970588 | 0.471429 |
| SLC34A2 AND FOLR2 | Lung Adenocarcinoma | 0.621118 | 0.549451 | 0.714286 |
| SLC34A2 AND BIRC5 | Lung Adenocarcinoma | 0.616667 | 0.74 | 0.528571 |
| FAP AND CLDN7 | Lung Adenocarcinoma | 0.614035 | 0.795455 | 0.5 |
| SLC34A2 AND VCAM1 | Lung Adenocarcinoma | 0.606061 | 0.526316 | 0.714286 |

FIG. 8 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SYT11 AND GPR50 | Glioma | 0.956522 | 0.956522 | 0.956522 | SLC34A2 AND SDC1 | Lung Adenocarcinoma | 0.603448 | 0.76087 | 0.5 |
| SYT11 AND BTN3A1 | Glioma | 0.933333 | 0.954545 | 0.913043 | SLC34A2 AND FAP | Lung Adenocarcinoma | 0.6 | 0.72 | 0.514286 |
| SYT11 AND CD163 | Glioma | 0.924242 | 0.968254 | 0.884058 | CEACAM6 AND SLC7A5 | Lung Adenocarcinoma | 0.603774 | 0.888889 | 0.457143 |
| SYT11 AND TGFBI | Glioma | 0.94964 | 0.942857 | 0.956522 | SLC34A2 AND HLA-DOB | Lung Adenocarcinoma | 0.632258 | 0.576471 | 0.7 |
| SYT11 AND ADAM7 | Glioma | 0.957143 | 0.943662 | 0.971014 | EPCAM AND PTK7 | Lung Adenocarcinoma | 0.605505 | 0.846154 | 0.471429 |
| SYT11 AND FSHR | Glioma | 0.94964 | 0.942857 | 0.956522 | MAGEA11 AND ULBP2 | Lung Carcinoma | 0.606061 | 0.857143 | 0.46875 |
| SYT11 AND CD36 | Glioma | 0.942029 | 0.942029 | 0.942029 | CXCR5 AND GPNMB | B-Cell Diffuse | 0.776119 | 0.866667 | 0.702703 |
| SYT11 AND ATP6V0A4 | Glioma | 0.948905 | 0.955882 | 0.942029 | CD180 AND GPNMB | B-Cell Diffuse | 0.746269 | 0.833333 | 0.675676 |
| SYT11 AND CD93 | Glioma | 0.957143 | 0.943662 | 0.971014 | CD79B AND GPNMB | B-Cell Diffuse | 0.738462 | 0.857143 | 0.648649 |
| SYT11 AND SV2C | Glioma | 0.94964 | 0.942857 | 0.956522 | CD79A AND GPNMB | B-Cell Diffuse | 0.733333 | 0.956522 | 0.594595 |
| SYT11 AND MIP | Glioma | 0.964029 | 0.957143 | 0.971014 | CD79B AND IL2RA | B-Cell Diffuse | 0.714286 | 0.757576 | 0.675676 |
| SYT11 AND SLC22A13 | Glioma | 0.971429 | 0.957746 | 0.985507 | CD72 AND GPNMB | B-Cell Diffuse | 0.711864 | 0.954545 | 0.567568 |
| SYT11 AND ICAM1 | Glioma | 0.934307 | 0.941176 | 0.927536 | P2RX5 AND GPNMB | B-Cell Diffuse | 0.711864 | 0.954545 | 0.567568 |
| SYT11 AND GYPC | Glioma | 0.964539 | 0.944444 | 0.985507 | CD79B AND VCAM1 | B-Cell Diffuse | 0.707692 | 0.821429 | 0.621622 |
| SYT11 AND FGF6 | Glioma | 0.971429 | 0.957746 | 0.985507 | FCRL2 AND GPNMB | B-Cell Diffuse | 0.689655 | 0.952381 | 0.540541 |
| SYT11 AND GABRG3 | Glioma | 0.971429 | 0.957746 | 0.985507 | P2RX5 AND VCAM1 | B-Cell Diffuse | 0.676056 | 0.705882 | 0.648649 |
| SYT11 AND BEST2 | Glioma | 0.971429 | 0.957746 | 0.985507 | CD72 AND VCAM1 | B-Cell Diffuse | 0.666667 | 0.71875 | 0.621622 |
| SYT11 AND SLC12A9 | Glioma | 0.971429 | 0.957746 | 0.985507 | CD79B AND TPBG | B-Cell Diffuse | 0.685714 | 0.727273 | 0.648649 |
| SYT11 AND OR2L2 | Glioma | 0.964029 | 0.957143 | 0.971014 | CD180 AND VCAM1 | B-Cell Diffuse | 0.658537 | 0.6 | 0.72973 |
| SYT11 AND TSHR | Glioma | 0.957143 | 0.943662 | 0.971014 | FCRL5 AND VCAM1 | B-Cell Diffuse | 0.738462 | 0.857143 | 0.648649 |
| SYT11 AND ADAM20 | Glioma | 0.94964 | 0.942857 | 0.956522 | CD79B AND CD276 | B-Cell Diffuse | 0.6875 | 0.814815 | 0.594595 |
| SYT11 AND P2RX4 | Glioma | 0.970588 | 0.985075 | 0.956522 | FCRL5 AND GPNMB | B-Cell Diffuse | 0.745763 | 1 | 0.594595 |
| SYT11 AND OR4N4 | Glioma | 0.957143 | 0.943662 | 0.971014 | CXCR5 AND VCAM1 | B-Cell Diffuse | 0.642857 | 0.574468 | 0.72973 |
| SYT11 AND LRRN4 | Glioma | 0.971429 | 0.957746 | 0.985507 | CR2 AND GPNMB | B-Cell Diffuse | 0.642857 | 0.947368 | 0.486486 |
| SYT11 AND SELP | Glioma | 0.957143 | 0.943662 | 0.971014 | CD79A AND VCAM1 | B-Cell Diffuse | 0.64 | 0.631579 | 0.648649 |
| SYT11 AND ZP4 | Glioma | 0.964539 | 0.944444 | 0.985507 | CD72 AND EDNRB | B-Cell Diffuse | 0.637681 | 0.6875 | 0.594595 |
| SYT11 AND GHSR | Glioma | 0.957143 | 0.943662 | 0.971014 | CD37 AND GPNMB | B-Cell Diffuse | 0.705882 | 0.774194 | 0.648649 |
| SYT11 AND KCNA10 | Glioma | 0.964029 | 0.957143 | 0.971014 | IL2RA AND GPNMB | B-Cell Diffuse | 0.632911 | 0.595238 | 0.675676 |
| SYT11 AND SLC22A12 | Glioma | 0.948905 | 0.955882 | 0.942029 | FCRL1 AND GPNMB | B-Cell Diffuse | 0.631579 | 0.9 | 0.486486 |
| SYT11 AND GJA3 | Glioma | 0.964539 | 0.944444 | 0.985507 | CD72 AND TPBG | B-Cell Diffuse | 0.630137 | 0.638889 | 0.621622 |
| SYT11 AND MLANA | Glioma | 0.942029 | 0.942029 | 0.942029 | CD79A AND EDNRB | B-Cell Diffuse | 0.628571 | 0.666667 | 0.594595 |
| GPR19 AND F2R | Glioma | 0.921875 | 1 | 0.855072 | CD79B AND EDNRB | B-Cell Diffuse | 0.623377 | 0.6 | 0.648649 |
| SYT11 AND CCR9 | Glioma | 0.957143 | 0.943662 | 0.971014 | CD180 AND EDNRB | B-Cell Diffuse | 0.613333 | 0.605263 | 0.621622 |
| SYT11 AND TRPC7 | Glioma | 0.94964 | 0.942857 | 0.956522 | P2RX5 AND EDNRB | B-Cell Diffuse | 0.608696 | 0.65625 | 0.567568 |
| SYT11 AND PROCR | Glioma | 0.956522 | 0.956522 | 0.956522 | FCRL5 AND IL2RA | B-Cell Diffuse | 0.698413 | 0.846154 | 0.594595 |
| SYT11 AND ESAM | Glioma | 0.964029 | 0.957143 | 0.971014 | CD72 AND IL2RA | B-Cell Diffuse | 0.605263 | 0.589744 | 0.621622 |
| SYT11 AND ROS1 | Glioma | 0.964029 | 0.957143 | 0.971014 | FCRL5 AND TPBG | B-Cell Diffuse | 0.676923 | 0.785714 | 0.594595 |
| SYT11 AND KCNU1 | Glioma | 0.964539 | 0.944444 | 0.985507 | P2RX5 AND IL2RA | B-Cell Diffuse | 0.60274 | 0.611111 | 0.594595 |
| SYT11 AND CATSPERD | Glioma | 0.957143 | 0.943662 | 0.971014 | FCRL5 AND CD34 | B-Cell Diffuse | 0.644068 | 0.863636 | 0.513514 |
| SYT11 AND TNFRSF10B | Glioma | 0.956522 | 0.956522 | 0.956522 | CD37 AND VCAM1 | B-Cell Diffuse | 0.611765 | 0.541667 | 0.702703 |
| SYT11 AND MRGPRX2 | Glioma | 0.942029 | 0.942029 | 0.942029 | CD79A AND SLC7A5 | B-Cell Diffuse | 0.666667 | 0.807692 | 0.567568 |
| SYT11 AND GALR1 | Glioma | 0.934307 | 0.941176 | 0.927536 | CD79A AND IL2RA | B-Cell Diffuse | 0.625 | 0.740741 | 0.540541 |
| SYT11 AND CHRNA9 | Glioma | 0.942029 | 0.942029 | 0.942029 | CD79B AND KDR | B-Cell Diffuse | 0.6875 | 0.814815 | 0.594595 |
| SYT11 AND CDH11 | Glioma | 0.924242 | 0.968254 | 0.884058 | P2RX5 AND SLC7A5 | B-Cell Diffuse | 0.612903 | 0.76 | 0.513514 |
| SYT11 AND STEAP4 | Glioma | 0.957143 | 0.943662 | 0.971014 | IL2RA AND SLC7A5 | Anaplastic Lymphoma | 0.642857 | 0.692308 | 0.6 |
| SLC22A16 AND EMP3 | AML | 0.909449 | 0.898833 | 0.920319 | IL2RA AND VCAM1 | Anaplastic Lymphoma | 0.62069 | 0.642857 | 0.6 |
| SLC22A16 AND CD44 | AML | 0.929006 | 0.946281 | 0.912351 | IL2RA AND TPBG | Anaplastic Lymphoma | 0.692308 | 0.818182 | 0.6 |
| SLC22A16 AND FMNL1 | AML | 0.895706 | 0.920168 | 0.87251 | IL2RA AND CLDN5 | Anaplastic Lymphoma | 0.692308 | 0.818182 | 0.6 |
| SLC22A16 AND SLC39A8 | AML | 0.882227 | 0.953704 | 0.820717 | CD79B AND GUCY2C | Mantle-Cell Lymphoma | 0.835821 | 0.965517 | 0.736842 |
| SLC22A16 AND MLC1 | AML | 0.865424 | 0.900862 | 0.832669 | P2RX5 AND GUCY2C | Mantle-Cell Lymphoma | 0.828571 | 0.90625 | 0.763158 |
| SLC22A16 AND SLC43A1 | AML | 0.834061 | 0.922705 | 0.760956 | P2RX5 AND FOLR1 | Mantle-Cell Lymphoma | 0.857143 | 0.846154 | 0.868421 |
| SLC22A16 AND SEMA4D | AML | 0.828452 | 0.872247 | 0.788845 | CD79B AND CD34 | Mantle-Cell Lymphoma | 0.823529 | 0.933333 | 0.736842 |
| SLC22A16 AND TTYH2 | AML | 0.811839 | 0.864865 | 0.76494 | P2RX5 AND CA9 | Mantle-Cell Lymphoma | 0.80597 | 0.931034 | 0.710526 |
| SLC22A16 AND STAB1 | AML | 0.778523 | 0.887755 | 0.693227 | P2RX5 AND FOLH1 | Mantle-Cell Lymphoma | 0.8 | 0.875 | 0.736842 |
| TTYH3 AND PTGIS | Liposarcoma | 0.636364 | 0.7 | 0.583333 | MS4A1 AND PMEL | Mantle-Cell Lymphoma | 0.791667 | 0.655172 | 1 |
| TTYH3 AND SLC6A7 | Liposarcoma | 0.626866 | 0.677419 | 0.583333 | P2RX5 AND CD70 | Mantle-Cell Lymphoma | 0.914286 | 1 | 0.842105 |
| TTYH3 AND ATP8B2 | Liposarcoma | 0.621622 | 0.605263 | 0.638889 | MS4A1 AND ERBB3 | Mantle-Cell Lymphoma | 0.783505 | 0.644068 | 1 |
| CD163 AND SLC6A7 | Liposarcoma | 0.658228 | 0.604651 | 0.722222 | P2RX5 AND ROR1 | Mantle-Cell Lymphoma | 0.782609 | 0.870968 | 0.710526 |
| TTYH3 AND PHLDB2 | Liposarcoma | 0.605263 | 0.575 | 0.638889 | MS4A1 AND CD70 | Mantle-Cell Lymphoma | 0.898551 | 1 | 0.815789 |
| TTYH3 AND CDH11 | Liposarcoma | 0.605263 | 0.575 | 0.638889 | CD79B AND FAP | Mantle-Cell Lymphoma | 0.78125 | 0.961538 | 0.657895 |
| TTYH3 AND TNFRSF12A | Liposarcoma | 0.630137 | 0.621622 | 0.638889 | MS4A1 AND ROR1 | Mantle-Cell Lymphoma | 0.779221 | 0.769231 | 0.789474 |
| STAB1 AND SLC6A7 | Liposarcoma | 0.666667 | 0.641026 | 0.694444 | MS4A1 AND ERBB2 | Mantle-Cell Lymphoma | 0.778947 | 0.649123 | 0.973684 |
| STAB1 AND EMP3 | Liposarcoma | 0.648649 | 0.631579 | 0.666667 | MS4A1 AND CD52 | Mantle-Cell Lymphoma | 0.778947 | 0.649123 | 0.973684 |
| STAB1 AND TGFBI | Liposarcoma | 0.648649 | 0.631579 | 0.666667 | P2RX5 AND CSPG4 | Mantle-Cell Lymphoma | 0.776119 | 0.896552 | 0.684211 |
| STAB1 AND IFNAR2 | Liposarcoma | 0.6 | 0.545455 | 0.666667 | MS4A1 AND TNFRSF10A | Mantle-Cell Lymphoma | 0.77551 | 0.633333 | 1 |
| STAB1 AND LRIG3 | Liposarcoma | 0.657895 | 0.625 | 0.694444 | P2RX5 AND ERBB3 | Mantle-Cell Lymphoma | 0.774194 | 0.654545 | 0.947368 |
| EMP3 AND VANGL1 | Liposarcoma | 0.666667 | 0.568627 | 0.805556 | MS4A1 AND LGR5 | Mantle-Cell Lymphoma | 0.774194 | 0.654545 | 0.947368 |
| STAB1 AND FAT1 | Liposarcoma | 0.724638 | 0.757576 | 0.694444 | MS4A1 AND ERBB4 | Mantle-Cell Lymphoma | 0.774194 | 0.654545 | 0.947368 |
| STAB1 AND CD93 | Liposarcoma | 0.675676 | 0.657895 | 0.694444 | P2RX5 AND SLC34A2 | Mantle-Cell Lymphoma | 0.769231 | 0.925926 | 0.657895 |
| CD163 AND VANGL1 | Liposarcoma | 0.717949 | 0.666667 | 0.777778 | MS4A1 AND MUC16 | Mantle-Cell Lymphoma | 0.767677 | 0.622951 | 1 |
| CD163 AND FAT1 | Liposarcoma | 0.701299 | 0.658537 | 0.75 | CD79B AND MUC16 | Mantle-Cell Lymphoma | 0.767123 | 0.8 | 0.736842 |
| STAB1 AND GPR137B | Liposarcoma | 0.621622 | 0.605263 | 0.638889 | MS4A1 AND CLDN2 | Mantle-Cell Lymphoma | 0.765957 | 0.642857 | 0.947368 |
| STAB1 AND GPR158 | Liposarcoma | 0.623377 | 0.585366 | 0.666667 | CD72 AND CD70 | Mantle-Cell Lymphoma | 0.818182 | 0.964286 | 0.710526 |
| STAB1 AND ABHD3 | Liposarcoma | 0.617284 | 0.555556 | 0.694444 | MS4A1 AND TNFRSF13C | Mantle-Cell Lymphoma | 0.894118 | 0.808511 | 1 |
| STAB1 AND CDH20 | Liposarcoma | 0.625 | 0.568182 | 0.694444 | CD79B AND CLDN2 | Mantle-Cell Lymphoma | 0.760563 | 0.818182 | 0.710526 |
| KCNJ10 AND HLA-DRB1 | B-Cell Diffuse | 0.75 | 0.771429 | 0.72973 | MS4A1 AND SDC1 | Mantle-Cell Lymphoma | 0.76 | 0.612903 | 1 |
| KCNJ10 AND LAPTM5 | B-Cell Diffuse | 0.724638 | 0.78125 | 0.675676 | CD70 AND CD52 | Mantle-Cell Lymphoma | 0.882353 | 1 | 0.789474 |

FIG. 8 (Cont.)

| Antigen Pair Logic | Cancer (short name) | F1 | Precision | Recall |
|---|---|---|---|---|
| KCNJ10 AND VAMP8 | B-Cell Diffuse | 0.622951 | 0.791667 | 0.513514 |
| GPR19 AND IL15RA | Anaplastic Lymphoma | 0.606061 | 0.555556 | 0.666667 |
| GPR137B AND SLC6A15 | Melanoma | 0.9 | 1 | 0.818182 |
| GPR19 AND TGFBI | Melanoma | 0.9 | 1 | 0.818182 |
| GPR137B AND GPR19 | Melanoma | 1 | 1 | 1 |
| GPR137B AND GPR158 | Melanoma | 0.842105 | 1 | 0.727273 |
| FAT1 AND GPR19 | Melanoma | 0.842105 | 1 | 0.727273 |
| PAQR7 AND GPR19 | Melanoma | 0.9 | 1 | 0.818182 |
| SLC22A5 AND GPR19 | Melanoma | 0.842105 | 1 | 0.727273 |
| GPR19 AND SLC50A1 | Melanoma | 0.9 | 1 | 0.818182 |
| GPR137B AND IFI6 | Melanoma | 0.818182 | 0.818182 | 0.818182 |
| GPR19 AND ATP7A | Melanoma | 0.857143 | 0.9 | 0.818182 |
| GPR19 AND THBD | Melanoma | 0.9 | 1 | 0.818182 |
| GPR137B AND TTYH2 | Melanoma | 0.785714 | 0.647059 | 1 |
| GPR137B AND GPR85 | Melanoma | 0.857143 | 0.9 | 0.818182 |
| FAT1 AND IFI6 | Melanoma | 0.777778 | 1 | 0.636364 |
| GPR137B AND SLC23A2 | Melanoma | 0.777778 | 1 | 0.636364 |
| GPR19 AND ATP7A | Neuroblastoma | 0.895349 | 0.875 | 0.916667 |
| CACNA1B AND ATP7A | Neuroblastoma | 0.882353 | 0.872093 | 0.892857 |
| TRPM8 AND SLCO1A2 | Prostate | 0.727273 | 0.571429 | 1 |
| UPK3A AND ATP8B1 | Prostate | 0.666667 | 0.6 | 0.75 |
| GGTLC1 AND CDH10 | Prostate | 0.8 | 0.666667 | 1 |
| ADAM2 AND GHR | Prostate | 0.666667 | 1 | 0.5 |
| UPK3A AND SLC43A1 | Prostate | 0.857143 | 1 | 0.75 |
| UPK3A AND ADAM2 | Prostate | 0.666667 | 1 | 0.5 |
| UPK3A AND CNTNAP2 | Prostate | 0.666667 | 0.6 | 0.75 |
| UPK3A AND SLC2A2 | Prostate | 0.666667 | 0.6 | 0.75 |
| UPK3A AND GRIA4 | Prostate | 0.666667 | 0.6 | 0.75 |
| UPK3A AND SELP | Prostate | 0.666667 | 0.6 | 0.75 |
| UPK3A AND STEAP4 | Prostate | 0.666667 | 1 | 0.5 |
| UPK3A AND GABRG3 | Prostate | 0.666667 | 0.6 | 0.75 |
| ADAM2 AND ATP8B1 | Prostate | 0.857143 | 1 | 0.75 |
| UPK3A AND GPR158 | Prostate | 0.666667 | 0.6 | 0.75 |
| STAB1 AND SLC6A7 | Sarcoma | 0.689655 | 0.833333 | 0.588235 |
| STAB1 AND EMP3 | Sarcoma | 0.727273 | 0.75 | 0.705882 |
| STAB1 AND TGFBI | Sarcoma | 0.645161 | 0.714286 | 0.588235 |
| CDH17 AND BST2 | Stomach | 0.829268 | 0.871795 | 0.790698 |
| CDH17 AND SLC6A6 | Stomach | 0.816327 | 0.727273 | 0.930233 |
| ATP8B1 AND CDH11 | Stomach | 0.871795 | 0.971429 | 0.790698 |
| ATP8B1 AND CD93 | Stomach | 0.871795 | 0.971429 | 0.790698 |
| ATP8B1 AND F2R | Stomach | 0.91358 | 0.973684 | 0.860465 |
| MUC17 AND ESAM | Stomach | 0.826667 | 0.96875 | 0.72093 |
| MUC17 AND IFI6 | Stomach | 0.753623 | 1 | 0.604651 |
| CDH17 AND IFI6 | Stomach | 0.621359 | 0.533333 | 0.744186 |
| MUC17 AND THBD | Stomach | 0.826667 | 0.96875 | 0.72093 |
| ATP8B1 AND PLVAP | Stomach | 0.860465 | 0.860465 | 0.860465 |
| MUC17 AND CD163 | Stomach | 0.815789 | 0.939394 | 0.72093 |
| CDH17 AND CDH11 | Stomach | 0.810127 | 0.888889 | 0.744186 |
| MUC17 AND SYT11 | Stomach | 0.842105 | 0.969697 | 0.744186 |
| MUC17 AND EMP3 | Stomach | 0.815789 | 0.939394 | 0.72093 |
| ATP8B1 AND TGFBI | Stomach | 0.839506 | 0.894737 | 0.790698 |
| MUC17 AND F2R | Stomach | 0.853333 | 1 | 0.744186 |
| MUC17 AND STEAP4 | Stomach | 0.842105 | 0.969697 | 0.744186 |
| MUC17 AND CD44 | Stomach | 0.842105 | 0.969697 | 0.744186 |
| MUC17 AND SLC1A5 | Stomach | 0.831169 | 0.941176 | 0.744186 |
| MUC17 AND EPHA2 | Stomach | 0.831169 | 0.941176 | 0.744186 |
| MUC17 AND SEMA4D | Stomach | 0.842105 | 0.969697 | 0.744186 |
| MUC17 AND GYPC | Stomach | 0.815789 | 0.939394 | 0.72093 |
| MUC17 AND BST2 | Stomach | 0.771429 | 1 | 0.627907 |
| MUC17 AND PROCR | Stomach | 0.826667 | 0.96875 | 0.72093 |
| MUC17 AND PLVAP | Stomach | 0.831169 | 0.941176 | 0.744186 |
| MUC17 AND S1PR1 | Stomach | 0.826667 | 0.96875 | 0.72093 |
| MUC17 AND CLSTN3 | Stomach | 0.842105 | 0.969697 | 0.744186 |
| MUC17 AND VANGL1 | Stomach | 0.831169 | 0.941176 | 0.744186 |
| MUC17 AND PHLDB2 | Stomach | 0.826667 | 0.96875 | 0.72093 |
| MUC17 AND STAB1 | Stomach | 0.831169 | 0.941176 | 0.744186 |
| MUC17 AND NRG3 | Stomach | 0.842105 | 0.969697 | 0.744186 |
| MUC17 AND ATP8B2 | Stomach | 0.8 | 0.9375 | 0.697674 |
| ATP8B1 AND STAB1 | Stomach | 0.847059 | 0.857143 | 0.837209 |
| MUC17 AND TTYH2 | Stomach | 0.842105 | 0.969697 | 0.744186 |
| ATP8B1 AND ESAM | Stomach | 0.888889 | 0.947368 | 0.837209 |
| ATP8B1 AND BST2 | Stomach | 0.837838 | 1 | 0.72093 |
| ATP8B1 AND MRGPRF | Stomach | 0.819277 | 0.85 | 0.790698 |
| NKAIN4 AND ITGAV | Astrocytoma | 0.746988 | 0.837838 | 0.673913 |
| BEST3 AND SLC39A6 | Astrocytoma | 0.708861 | 0.848485 | 0.608696 |
| CRB1 AND SLC39A6 | Astrocytoma | 0.708333 | 0.68 | 0.73913 |
| CRB1 AND EDNRB | Astrocytoma | 0.704762 | 0.627119 | 0.804348 |

| Antigen Pair Logic | Cancer (short name) | F1 | Precision | Recall |
|---|---|---|---|---|
| MS4A1 AND SLC7A5 | Mantle-Cell Lymphoma | 0.756098 | 0.704545 | 0.815789 |
| EDNRB AND IL11RA | Melanoma | 0.9 | 1 | 0.818182 |
| EDNRB AND CSPG4 | Melanoma | 0.9 | 1 | 0.818182 |
| EDNRB AND VCAM1 | Melanoma | 0.9 | 1 | 0.818182 |
| EDNRB AND GPNMB | Melanoma | 0.9 | 1 | 0.818182 |
| EDNRB AND L1CAM | Melanoma | 0.9 | 1 | 0.818182 |
| EDNRB AND AXL | Melanoma | 0.842105 | 1 | 0.727273 |
| EDNRB AND TRPM4 | Melanoma | 0.842105 | 1 | 0.727273 |
| EDNRB AND STEAP1 | Melanoma | 0.842105 | 1 | 0.727273 |
| EDNRB AND CD34 | Melanoma | 0.842105 | 1 | 0.727273 |
| EDNRB AND SLC7A5 | Melanoma | 0.842105 | 1 | 0.727273 |
| EDNRB AND CLDN12 | Melanoma | 0.842105 | 1 | 0.727273 |
| EDNRB AND FAP | Melanoma | 0.842105 | 1 | 0.727273 |
| EDNRB AND IGF1R | Melanoma | 0.842105 | 1 | 0.727273 |
| EDNRB AND ERBB2 | Melanoma | 0.842105 | 1 | 0.727273 |
| EDNRB AND CD70 | Melanoma | 0.842105 | 1 | 0.727273 |
| EDNRB AND CLDN23 | Melanoma | 0.777778 | 1 | 0.636364 |
| CLDN12 AND GPNMB | Melanoma | 0.777778 | 1 | 0.636364 |
| ALK AND GPNMB | Neuroblastoma | 0.825806 | 0.901408 | 0.761905 |
| ALK AND FOLR1 | Neuroblastoma | 0.8125 | 0.855263 | 0.77381 |
| L1CAM AND CBX3 | Neuroblastoma | 0.8 | 1 | 0.666667 |
| ALK AND GPC3 | Neuroblastoma | 0.797468 | 0.851351 | 0.75 |
| ALK AND CD52 | Neuroblastoma | 0.794872 | 0.861111 | 0.738095 |
| ALK AND ERBB3 | Neuroblastoma | 0.792453 | 0.84 | 0.75 |
| L1CAM AND GPNMB | Neuroblastoma | 0.790698 | 0.772727 | 0.809524 |
| ALK AND OAS1 | Neuroblastoma | 0.782051 | 0.847222 | 0.72619 |
| ALK AND CD34 | Neuroblastoma | 0.781457 | 0.880597 | 0.702381 |
| ALK AND MST1R | Neuroblastoma | 0.77707 | 0.835616 | 0.72619 |
| L1CAM AND CD276 | Neuroblastoma | 0.814815 | 0.846154 | 0.785714 |
| ALK AND CLDN3 | Neuroblastoma | 0.771242 | 0.855072 | 0.702381 |
| ALK AND MSLN | Neuroblastoma | 0.763158 | 0.852941 | 0.690476 |
| ALK AND ALDH1A1 | Neuroblastoma | 0.76129 | 0.830986 | 0.702381 |
| ALK AND MUC4 | Neuroblastoma | 0.76129 | 0.830986 | 0.702381 |
| ALK AND CD72 | Neuroblastoma | 0.754967 | 0.850746 | 0.678571 |
| ALK AND FOLH1 | Neuroblastoma | 0.753247 | 0.828571 | 0.690476 |
| ALK AND FCRL2 | Neuroblastoma | 0.75 | 0.838235 | 0.678571 |
| ALK AND IL3RA | Neuroblastoma | 0.728477 | 0.820896 | 0.654762 |
| ALK AND EDNRB | Neuroblastoma | 0.724832 | 0.830769 | 0.642857 |
| ALK AND ULBP1 | Neuroblastoma | 0.721088 | 0.84127 | 0.630952 |
| ALK AND CXCR5 | Neuroblastoma | 0.72 | 0.818182 | 0.642857 |
| ALK AND ABCB5 | Neuroblastoma | 0.72 | 0.818182 | 0.642857 |
| L1CAM AND BMPR1B | Neuroblastoma | 0.712329 | 0.83871 | 0.619048 |
| ALK AND TNFRSF17 | Neuroblastoma | 0.711409 | 0.815385 | 0.630952 |
| NCAM1 AND EGFR | Oligodendroglioma | 0.666667 | 0.541667 | 0.866667 |
| SLC7A5 AND MUC13 | Oligodendroglioma | 0.72 | 0.9 | 0.6 |
| SLC7A5 AND MSLN | Oligodendroglioma | 0.692308 | 0.818182 | 0.6 |
| SLC7A5 AND CLDN9 | Oligodendroglioma | 0.689655 | 0.714286 | 0.666667 |
| ABCB5 AND BMPR1B | Oligodendroglioma | 0.714286 | 0.769231 | 0.666667 |
| ABCB5 AND SLC7A5 | Oligodendroglioma | 0.647059 | 0.578947 | 0.733333 |
| SLC7A5 AND GPA33 | Oligodendroglioma | 0.6 | 0.6 | 0.6 |
| NCAM1 AND EDNRB | Oligodendroglioma | 0.615385 | 0.727273 | 0.533333 |
| SSTR2 AND BMPR1B | Oligodendroglioma | 0.695652 | 1 | 0.533333 |
| SSTR3 AND SLC7A5 | Oligodendroglioma | 0.642857 | 0.692308 | 0.6 |
| SLC7A5 AND CLDN18 | Oligodendroglioma | 0.625 | 0.588235 | 0.666667 |
| SLC7A5 AND ITGB3 | Oligodendroglioma | 0.606061 | 0.555556 | 0.666667 |
| CLDN11 AND GPA33 | Oligodendroglioma | 0.714286 | 0.769231 | 0.666667 |
| SSTR2 AND EDNRB | Oligodendroglioma | 0.615385 | 0.727273 | 0.533333 |
| ABCB5 AND SLC39A6 | Oligodendroglioma | 0.666667 | 0.611111 | 0.733333 |
| MUC16 AND NCAM1 | Ovarian | 0.666667 | 0.777778 | 0.583333 |
| STEAP2 AND EPCAM | Prostate | 0.857143 | 1 | 0.75 |
| STEAP1 AND EPCAM | Prostate | 0.857143 | 1 | 0.75 |
| STEAP2 AND CLDN8 | Prostate | 1 | 1 | 1 |
| STEAP2 AND EPHA3 | Prostate | 0.8 | 0.666667 | 1 |
| STEAP2 AND MUC1 | Prostate | 1 | 1 | 1 |
| STEAP2 AND VCAM1 | Prostate | 1 | 1 | 1 |
| STEAP2 AND CBX3 | Prostate | 0.857143 | 1 | 0.75 |
| STEAP1 AND P2RX5 | Prostate | 0.75 | 0.75 | 0.75 |
| STEAP2 AND IL13RA1 | Prostate | 0.888889 | 0.8 | 1 |
| STEAP1 AND MUC1 | Prostate | 0.857143 | 1 | 0.75 |
| STEAP2 AND IL20RA | Prostate | 0.857143 | 1 | 0.75 |
| STEAP2 AND IL2RA | Prostate | 0.727273 | 0.571429 | 1 |
| STEAP2 AND BIRC5 | Prostate | 0.727273 | 0.571429 | 1 |
| STEAP2 AND ABCB5 | Prostate | 0.727273 | 0.571429 | 1 |
| STEAP2 AND STEAP1 | Prostate | 0.727273 | 0.571429 | 1 |
| STEAP2 AND HLA-DOB | Prostate | 0.727273 | 0.571429 | 1 |
| STEAP2 AND FAP | Prostate | 0.727273 | 0.571429 | 1 |
| STEAP2 AND LGR5 | Prostate | 0.727273 | 0.571429 | 1 |

FIG. 8 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NCAM1 AND BEST3 | Astrocytoma | 0.694737 | 0.673469 | 0.717391 | STEAP2 AND TNFRSF10A | Prostate | 0.727273 | 0.571429 | 1 |
| BEST3 AND EDNRB | Astrocytoma | 0.692308 | 0.84375 | 0.586957 | STEAP2 AND CLDN3 | Prostate | 0.727273 | 0.571429 | 1 |
| NCAM1 AND LAPTM5 | Astrocytoma | 0.690476 | 0.763158 | 0.630435 | STEAP2 AND CLDN2 | Prostate | 0.727273 | 0.571429 | 1 |
| SLCO1C1 AND EDNRB | Astrocytoma | 0.680412 | 0.647059 | 0.717391 | STEAP2 AND MS4A1 | Prostate | 0.727273 | 0.571429 | 1 |
| NCAM1 AND F2R | Astrocytoma | 0.680412 | 0.647059 | 0.717391 | STEAP2 AND MUC16 | Prostate | 0.727273 | 0.571429 | 1 |
| BEST3 AND BMPR1B | Astrocytoma | 0.666667 | 0.8125 | 0.565217 | STEAP2 AND CD33 | Prostate | 0.727273 | 0.571429 | 1 |
| CRB1 AND NCAM1 | Astrocytoma | 0.659091 | 0.690476 | 0.630435 | STEAP2 AND CLDN23 | Prostate | 0.727273 | 0.571429 | 1 |
| BEST3 AND MUC1 | Astrocytoma | 0.658824 | 0.717949 | 0.608696 | STEAP2 AND CD37 | Prostate | 0.727273 | 0.571429 | 1 |
| BEST3 AND FOLH1 | Astrocytoma | 0.651163 | 0.7 | 0.608696 | STEAP2 AND SST | Prostate | 0.727273 | 0.571429 | 1 |
| KCNJ10 AND CD276 | Astrocytoma | 0.650602 | 0.72973 | 0.586957 | STEAP2 AND MOK | Prostate | 0.727273 | 0.571429 | 1 |
| NKAIN4 AND AXL | Astrocytoma | 0.649351 | 0.806452 | 0.543478 | STEAP2 AND SSTR1 | Prostate | 0.727273 | 0.571429 | 1 |
| BEST3 AND VCAM1 | Astrocytoma | 0.649351 | 0.806452 | 0.543478 | STEAP2 AND P2RX5 | Prostate | 0.727273 | 0.571429 | 1 |
| NCAM1 AND SEMA4B | Astrocytoma | 0.647619 | 0.576271 | 0.73913 | STEAP2 AND WT1 | Prostate | 0.727273 | 0.571429 | 1 |
| BMPR1B AND F2R | Astrocytoma | 0.647619 | 0.576271 | 0.73913 | STEAP2 AND CD160 | Prostate | 0.727273 | 0.571429 | 1 |
| MLC1 AND CD276 | Astrocytoma | 0.641975 | 0.742857 | 0.565217 | STEAP1 AND EPHA3 | Prostate | 0.857143 | 1 | 0.75 |
| SLC1A2 AND EDNRB | Astrocytoma | 0.637931 | 0.528571 | 0.804348 | STEAP1 AND CD72 | Prostate | 0.75 | 0.75 | 0.75 |
| ASTN1 AND EDNRB | Astrocytoma | 0.635294 | 0.692308 | 0.586957 | STEAP2 AND TNFRSF13C | Prostate | 0.727273 | 0.571429 | 1 |
| FXYD6 AND EDNRB | Astrocytoma | 0.630631 | 0.538462 | 0.76087 | STEAP1 AND IGF1R | Prostate | 0.75 | 0.75 | 0.75 |
| CSPG5 AND EDNRB | Astrocytoma | 0.626506 | 0.702703 | 0.565217 | STEAP1 AND SLC39A6 | Prostate | 0.75 | 0.75 | 0.75 |
| BEST3 AND L1CAM | Astrocytoma | 0.626506 | 0.702703 | 0.565217 | STEAP1 AND CLDN4 | Prostate | 0.75 | 0.75 | 0.75 |
| GABBR2 AND SLC39A6 | Astrocytoma | 0.622642 | 0.55 | 0.717391 | STEAP1 AND ERBB2 | Prostate | 0.75 | 0.75 | 0.75 |
| BEST3 AND ERBB4 | Astrocytoma | 0.621622 | 0.821429 | 0.5 | STEAP1 AND IL20RA | Prostate | 0.857143 | 1 | 0.75 |
| CRB1 AND SLC7A5 | Astrocytoma | 0.62069 | 0.658537 | 0.586957 | STEAP1 AND BMPR1B | Prostate | 0.75 | 0.75 | 0.75 |
| SLCO1C1 AND SLC39A6 | Astrocytoma | 0.619048 | 0.684211 | 0.565217 | STEAP1 AND CLDN8 | Prostate | 0.857143 | 1 | 0.75 |
| BEST3 AND CD79A | Astrocytoma | 0.617284 | 0.714286 | 0.543478 | STEAP1 AND CLDN3 | Prostate | 0.75 | 0.75 | 0.75 |
| CRB1 AND SDC1 | Astrocytoma | 0.617021 | 0.604167 | 0.630435 | STEAP2 AND MSLN | Prostate | 0.727273 | 0.571429 | 1 |
| SYT6 AND SLC39A6 | Astrocytoma | 0.613636 | 0.642857 | 0.586957 | STEAP2 AND DNAJB8 | Prostate | 0.727273 | 0.571429 | 1 |
| CRB1 AND CLDN9 | Astrocytoma | 0.612245 | 0.576923 | 0.652174 | STEAP1 AND PTK7 | Prostate | 0.75 | 0.75 | 0.75 |
| CRB1 AND PTK7 | Astrocytoma | 0.609756 | 0.694444 | 0.543478 | STEAP1 AND SSTR1 | Prostate | 0.75 | 0.75 | 0.75 |
| CRB1 AND TNFRSF10A | Astrocytoma | 0.607843 | 0.553571 | 0.673913 | STEAP1 AND ENPP3 | Prostate | 0.666667 | 1 | 0.5 |
| SLC1A2 AND CD180 | Astrocytoma | 0.606742 | 0.627907 | 0.586957 | STEAP2 AND ENPP3 | Prostate | 0.666667 | 1 | 0.5 |
| SLC1A2 AND PTK7 | Astrocytoma | 0.606742 | 0.627907 | 0.586957 | STEAP1 AND PROM1 | Prostate | 0.666667 | 1 | 0.5 |
| KCNJ10 AND CD180 | Astrocytoma | 0.60241 | 0.675676 | 0.543478 | STEAP1 AND CLDN7 | Prostate | 0.75 | 0.75 | 0.75 |
| CRB1 AND IL3RA | Astrocytoma | 0.601942 | 0.54386 | 0.673913 | ABCA5 AND EPCAM | Prostate | 0.666667 | 1 | 0.5 |
| ADCY8 AND EDNRB | Astrocytoma | 0.613861 | 0.563636 | 0.673913 | STEAP1 AND ROR1 | Prostate | 0.666667 | 1 | 0.5 |
| FAP AND PPAPDC1A | Breast | 0.845361 | 0.953488 | 0.759259 | STEAP1 AND CLDN18 | Prostate | 0.666667 | 0.6 | 0.75 |
| FAP AND SORL1 | Breast | 0.75 | 0.970588 | 0.611111 | STEAP1 AND NCAM1 | Prostate | 0.666667 | 0.6 | 0.75 |
| PPAPDC1A AND CLDN4 | Breast | 0.73913 | 0.894737 | 0.62963 | STEAP1 AND CLDN11 | Prostate | 0.666667 | 0.6 | 0.75 |
| PPAPDC1A AND CLDN7 | Breast | 0.73913 | 0.894737 | 0.62963 | STEAP1 AND ULBP1 | Prostate | 0.666667 | 0.6 | 0.75 |
| PPAPDC1A AND SPON2 | Breast | 0.741573 | 0.942857 | 0.611111 | STEAP1 AND ULBP2 | Prostate | 0.666667 | 0.6 | 0.75 |
| PPAPDC1A AND MUC1 | Breast | 0.765957 | 0.9 | 0.666667 | STEAP1 AND PSCA | Prostate | 0.666667 | 0.6 | 0.75 |
| PPAPDC1A AND SDC1 | Breast | 0.744681 | 0.875 | 0.648148 | STEAP1 AND ULBP3 | Prostate | 0.666667 | 0.6 | 0.75 |
| FAP AND FLVCR1 | Breast | 0.875 | 1 | 0.777778 | STEAP1 AND SSTR2 | Prostate | 0.666667 | 0.6 | 0.75 |
| FAP AND TNFRSF12A | Breast | 0.795918 | 0.886364 | 0.722222 | STEAP1 AND SST | Prostate | 0.666667 | 0.6 | 0.75 |
| FAP AND PPAPDC1B | Breast | 0.829787 | 0.975 | 0.722222 | STEAP1 AND FCRL2 | Prostate | 0.666667 | 0.6 | 0.75 |
| FAP AND VANGL1 | Breast | 0.808511 | 0.95 | 0.703704 | STEAP1 AND CR2 | Prostate | 0.666667 | 0.6 | 0.75 |
| FAP AND BST2 | Breast | 0.83871 | 1 | 0.722222 | STEAP1 AND TNFRSF10A | Prostate | 0.666667 | 0.6 | 0.75 |
| FAP AND LRRC8E | Breast | 0.795699 | 0.948718 | 0.685185 | STEAP1 AND MST1R | Prostate | 0.666667 | 0.6 | 0.75 |
| PPAPDC1A AND GPNMB | Breast | 0.747253 | 0.918919 | 0.62963 | STEAP1 AND IL3RA | Prostate | 0.666667 | 0.6 | 0.75 |
| PPAPDC1A AND ITGB6 | Breast | 0.742268 | 0.837209 | 0.666667 | STEAP1 AND DLL3 | Prostate | 0.666667 | 0.6 | 0.75 |
| FAP AND SLCO1B1 | Breast | 0.762887 | 0.860465 | 0.685185 | FAP AND ULBP2 | Sarcoma | 0.740741 | 1 | 0.588235 |
| FAP AND CXCL16 | Breast | 0.857143 | 0.954545 | 0.777778 | FAP AND SLC7A5 | Sarcoma | 0.692308 | 1 | 0.529412 |
| FAP AND IFNAR2 | Breast | 0.741573 | 0.942857 | 0.611111 | FAP AND FOLH1 | Sarcoma | 0.740741 | 1 | 0.588235 |
| TPBG AND BST2 | Breast | 0.712644 | 0.939394 | 0.574074 | FAP AND CD276 | Sarcoma | 0.827586 | 1 | 0.705882 |
| FAP AND CACNG6 | Breast | 0.803922 | 0.854167 | 0.759259 | FAP AND IL13RA1 | Sarcoma | 0.692308 | 1 | 0.529412 |
| FAP AND SLC10A1 | Breast | 0.838095 | 0.862745 | 0.814815 | FAP AND EGFR | Sarcoma | 0.827586 | 1 | 0.705882 |
| FAP AND SEMA4D | Breast | 0.833333 | 0.952381 | 0.740741 | FAP AND TPBG | Sarcoma | 0.740741 | 1 | 0.588235 |
| FAP AND OXTR | Breast | 0.703297 | 0.864865 | 0.592593 | FAP AND ABCB5 | Sarcoma | 0.827586 | 1 | 0.705882 |
| FAP AND ADAM29 | Breast | 0.838095 | 0.862745 | 0.814815 | FAP AND ULBP1 | Sarcoma | 0.866667 | 1 | 0.764706 |
| FAP AND CALHM1 | Breast | 0.75 | 0.857143 | 0.666667 | FAP AND FCRL5 | Sarcoma | 0.827586 | 1 | 0.705882 |
| PPAPDC1A AND IL13RA1 | Breast | 0.731183 | 0.871795 | 0.62963 | MUC13 AND THY1 | Stomach | 0.939759 | 0.975 | 0.906977 |
| FAP AND GABRG2 | Breast | 0.717391 | 0.868421 | 0.611111 | EPCAM AND THY1 | Stomach | 0.816327 | 0.727273 | 0.930233 |
| PPAPDC1A AND AXL | Breast | 0.704545 | 0.911765 | 0.574074 | CEACAM5 AND THY1 | Stomach | 0.857143 | 0.970588 | 0.767442 |
| FAP AND KCND2 | Breast | 0.871287 | 0.93617 | 0.814815 | CLDN18 AND MUC13 | Stomach | 0.878049 | 0.923077 | 0.837209 |
| PPAPDC1A AND STEAP1 | Breast | 0.770833 | 0.880952 | 0.685185 | MUC13 AND SPON2 | Stomach | 0.963855 | 1 | 0.930233 |
| TPBG AND SLC38A1 | Breast | 0.698795 | 1 | 0.537037 | CLDN18 AND BIRC5 | Stomach | 0.777778 | 0.744681 | 0.813953 |
| FAP AND GUCY2D | Breast | 0.77551 | 0.863636 | 0.703704 | CLDN18 AND STEAP1 | Stomach | 0.897436 | 1 | 0.813953 |
| PPAPDC1A AND ANXA1 | Breast | 0.712871 | 0.765957 | 0.666667 | CLDN18 AND EPHB2 | Stomach | 0.857143 | 0.970588 | 0.767442 |
| TPBG AND ENPP1 | Breast | 0.696629 | 0.885714 | 0.574074 | CLDN18 AND THY1 | Stomach | 0.871795 | 0.971429 | 0.790698 |
| FAP AND LPPR3 | Breast | 0.715789 | 0.829268 | 0.62963 | MUC13 AND FAP | Stomach | 0.860465 | 0.860465 | 0.860465 |
| SLC2A2 AND CD34 | Liver | 0.8 | 1 | 0.666667 | CLDN18 AND EPCAM | Stomach | 0.888889 | 0.947368 | 0.837209 |
| SLCO1B1 AND CD34 | Liver | 0.8 | 1 | 0.666667 | CLDN18 AND MST1R | Stomach | 0.810127 | 0.888889 | 0.744186 |
| SLC43A1 AND ERBB3 | Liver | 0.909091 | 1 | 0.833333 | CLDN18 AND CEACAM5 | Stomach | 0.805556 | 1 | 0.674419 |
| SLCO1B1 AND EPHB2 | Liver | 1 | 1 | 1 | EPCAM AND SLC7A5 | Stomach | 0.917647 | 0.928571 | 0.906977 |
| SLC2A2 AND ABCB5 | Liver | 0.769231 | 0.714286 | 0.833333 | CLDN18 AND PROM1 | Stomach | 0.746988 | 0.775 | 0.72093 |
| SLC2A2 AND ERBB3 | Liver | 0.769231 | 0.714286 | 0.833333 | MUC13 AND SLC7A5 | Stomach | 0.938272 | 1 | 0.883721 |
| SLC2A2 AND IL3RA | Liver | 0.769231 | 0.714286 | 0.833333 | CLDN18 AND SST | Stomach | 0.764045 | 0.73913 | 0.790698 |

FIG. 8 (Cont.)

| Antigen Pair Logic | Cancer (short name) | F1 | Precision | Recall |
|---|---|---|---|---|
| SLCO1B1 AND LGR5 | Liver | 0.769231 | 0.714286 | 0.833333 |
| SLCO1B1 AND ERBB3 | Liver | 0.769231 | 0.714286 | 0.833333 |
| SLC2A2 AND LGR5 | Liver | 0.769231 | 0.714286 | 0.833333 |
| SLC2A2 AND ULBP1 | Liver | 0.769231 | 0.714286 | 0.833333 |
| SLC13A5 AND ERBB3 | Liver | 0.769231 | 0.714286 | 0.833333 |
| SLC17A2 AND EPHB2 | Liver | 0.909091 | 1 | 0.833333 |
| SLC17A2 AND LGR5 | Liver | 0.769231 | 0.714286 | 0.833333 |
| SLC2A2 AND SSTR5 | Liver | 0.8 | 1 | 0.666667 |
| SLCO1B1 AND ITGB6 | Liver | 0.75 | 0.6 | 1 |
| SLCO1B1 AND VTCN1 | Liver | 0.8 | 1 | 0.666667 |
| SLC2A2 AND EPHB2 | Liver | 1 | 1 | 1 |
| SLCO1B1 AND SSTR5 | Liver | 0.727273 | 0.8 | 0.666667 |
| SLC2A2 AND ULBP2 | Liver | 0.857143 | 0.75 | 1 |
| SLC13A5 AND CD34 | Liver | 0.727273 | 0.8 | 0.666667 |
| SLC6A12 AND ERBB3 | Liver | 0.769231 | 0.714286 | 0.833333 |
| SLC13A5 AND EPHB2 | Liver | 0.769231 | 0.714286 | 0.833333 |
| SLCO1B1 AND IL3RA | Liver | 0.714286 | 0.625 | 0.833333 |
| SLC2A2 AND VTCN1 | Liver | 0.8 | 1 | 0.666667 |
| SLCO1B1 AND ULBP2 | Liver | 0.75 | 0.6 | 1 |
| SLCO1B1 AND SSTR3 | Liver | 0.714286 | 0.625 | 0.833333 |
| SLC17A2 AND VTCN1 | Liver | 0.8 | 1 | 0.666667 |
| SLC2A2 AND CD22 | Liver | 0.8 | 1 | 0.666667 |
| SLC17A2 AND SSTR5 | Liver | 0.727273 | 0.8 | 0.666667 |
| SLC10A1 AND EPHB2 | Liver | 0.8 | 1 | 0.666667 |
| SLC2A2 AND L1CAM | Liver | 0.857143 | 0.75 | 1 |
| SLCO1B1 AND CLDN9 | Liver | 0.8 | 0.666667 | 1 |
| SLCO1B1 AND GPA33 | Liver | 0.75 | 0.6 | 1 |
| SLCO1B1 AND GUCY2C | Liver | 0.75 | 0.6 | 1 |
| SLC2A2 AND CLDN9 | Liver | 0.8 | 1 | 0.666667 |
| SLC2A2 AND ROR1 | Liver | 0.8 | 1 | 0.666667 |
| SLC10A1 AND IL3RA | Liver | 0.714286 | 0.625 | 0.833333 |
| SLC17A2 AND SSTR3 | Liver | 0.714286 | 0.625 | 0.833333 |
| SLCO1B1 AND L1CAM | Liver | 0.75 | 0.6 | 1 |
| SLCO1B1 AND MUC4 | Liver | 0.75 | 0.6 | 1 |
| SLC2A2 AND ITGB6 | Liver | 0.857143 | 0.75 | 1 |
| SLCO1B1 AND ULBP1 | Liver | 0.666667 | 0.555556 | 0.833333 |
| SLC17A2 AND ULBP2 | Liver | 0.666667 | 0.555556 | 0.833333 |
| SLC2A2 AND TNFRSF8 | Liver | 0.8 | 1 | 0.666667 |
| SLCO1B1 AND ABCB5 | Liver | 0.666667 | 0.555556 | 0.833333 |
| SLC17A2 AND ITGB6 | Liver | 0.666667 | 0.555556 | 0.833333 |
| SLCO1B1 AND TNFRSF8 | Liver | 0.8 | 1 | 0.666667 |
| SLC17A2 AND CLDN9 | Liver | 0.714286 | 0.625 | 0.833333 |
| SLC17A2 AND CD34 | Liver | 0.666667 | 1 | 0.5 |
| SLC30A10 AND CLDN1 | Liver | 0.666667 | 1 | 0.5 |
| SLCO1B1 AND CD22 | Liver | 0.8 | 1 | 0.666667 |
| SLCO1B1 AND MST1R | Liver | 0.666667 | 1 | 0.5 |
| SLCO1B1 AND PTK7 | Liver | 0.666667 | 1 | 0.5 |
| SLC2A2 AND IL2RA | Liver | 0.666667 | 0.666667 | 0.666667 |
| SLC2A2 AND PTK7 | Liver | 0.666667 | 1 | 0.5 |
| SLC2A2 AND CSPG4 | Liver | 0.666667 | 0.666667 | 0.666667 |
| ABCG8 AND RAET1E | Liver | 0.666667 | 1 | 0.5 |
| ALCAM AND SDC1 | Liver | 0.909091 | 1 | 0.833333 |
| SLC17A2 AND ERBB3 | Liver | 0.666667 | 0.666667 | 0.666667 |
| SLC2A2 AND CLDN6 | Liver | 0.833333 | 0.833333 | 0.833333 |
| C8B AND EPHB2 | Liver | 0.666667 | 1 | 0.5 |
| ABCG5 AND CD34 | Liver | 0.666667 | 1 | 0.5 |
| ABCG8 AND CD70 | Liver | 0.8 | 1 | 0.666667 |
| SLC10A1 AND LGR5 | Liver | 0.666667 | 0.666667 | 0.666667 |
| SLC2A2 AND MUC4 | Liver | 0.857143 | 0.75 | 1 |
| SLC17A2 AND GPA33 | Liver | 0.666667 | 0.555556 | 0.833333 |
| SLC2A2 AND CR2 | Liver | 0.666667 | 0.666667 | 0.666667 |
| SLC10A1 AND CD34 | Liver | 0.666667 | 1 | 0.5 |
| SLC2A2 AND SSTR4 | Liver | 0.666667 | 0.666667 | 0.666667 |
| SLC17A2 AND GUCY2C | Liver | 0.666667 | 0.555556 | 0.833333 |
| FAP AND CD82 | Pancreas | 0.842105 | 1 | 0.727273 |
| CLDN2 AND LAMP5 | Pancreas | 0.736842 | 0.875 | 0.636364 |
| FAP AND HLA-DRB1 | Pancreas | 0.777778 | 1 | 0.636364 |
| FAP AND LAPTM5 | Pancreas | 0.705882 | 1 | 0.545455 |
| FAP AND CD74 | Pancreas | 0.777778 | 1 | 0.636364 |
| FAP AND LRRC52 | Pancreas | 0.777778 | 1 | 0.636364 |
| FAP AND P2RX4 | Pancreas | 0.777778 | 1 | 0.636364 |
| FAP AND TNFRSF10B | Pancreas | 0.842105 | 1 | 0.727273 |
| FAP AND CCR9 | Pancreas | 0.842105 | 1 | 0.727273 |
| FAP AND SORL1 | Pancreas | 0.842105 | 1 | 0.727273 |
| FAP AND CXCL16 | Pancreas | 0.842105 | 1 | 0.727273 |
| FAP AND SEMA4D | Pancreas | 0.842105 | 1 | 0.727273 |
| FAP AND UMODL1 | Pancreas | 0.842105 | 1 | 0.727273 |

| Antigen Pair Logic | Cancer (short name) | F1 | Precision | Recall |
|---|---|---|---|---|
| CLDN18 AND GUCY2C | Stomach | 0.73913 | 0.693878 | 0.790698 |
| EPCAM AND FAP | Stomach | 0.817204 | 0.76 | 0.883721 |
| CLDN18 AND SPON2 | Stomach | 0.795455 | 0.777778 | 0.813953 |
| CLDN18 AND PSCA | Stomach | 0.682927 | 0.717949 | 0.651163 |
| CLDN18 AND ERBB3 | Stomach | 0.888889 | 0.947368 | 0.837209 |
| CLDN18 AND CBX3 | Stomach | 0.853333 | 1 | 0.744186 |
| CLDN18 AND SSTR4 | Stomach | 0.725275 | 0.6875 | 0.767442 |
| CLDN18 AND MAGEA1 | Stomach | 0.808989 | 0.782609 | 0.837209 |
| CLDN18 AND FCRL5 | Stomach | 0.8 | 0.765957 | 0.837209 |
| CLDN18 AND AFP | Stomach | 0.765957 | 0.705882 | 0.837209 |
| MUC13 AND CLDN1 | Stomach | 0.965517 | 0.954545 | 0.976744 |
| CA9 AND EPCAM | Stomach | 0.712329 | 0.866667 | 0.604651 |
| CEACAM5 AND SPON2 | Stomach | 0.839506 | 0.894737 | 0.790698 |
| CLDN18 AND GAGE1 | Stomach | 0.774194 | 0.72 | 0.837209 |
| CLDN18 AND SSTR2 | Stomach | 0.765957 | 0.705882 | 0.837209 |
| CLDN18 AND DLL3 | Stomach | 0.795455 | 0.777778 | 0.813953 |
| CEACAM5 AND FAP | Stomach | 0.837838 | 1 | 0.72093 |
| CLDN18 AND ULBP1 | Stomach | 0.765957 | 0.705882 | 0.837209 |
| CLDN18 AND TNFSF11 | Stomach | 0.786517 | 0.76087 | 0.813953 |
| CLDN18 AND NCAM1 | Stomach | 0.75 | 0.733333 | 0.767442 |
| MUC13 AND CD34 | Stomach | 0.845361 | 0.759259 | 0.953488 |
| CLDN18 AND MAGEA11 | Stomach | 0.747253 | 0.708333 | 0.790698 |
| CLDN18 AND ABCB5 | Stomach | 0.765957 | 0.705882 | 0.837209 |
| CLDN18 AND MUC16 | Stomach | 0.73913 | 0.693878 | 0.790698 |
| CLDN18 AND DNAJB8 | Stomach | 0.808989 | 0.782609 | 0.837209 |
| CLDN18 AND MUC4 | Stomach | 0.774194 | 0.72 | 0.837209 |
| CLDN18 AND SSX1 | Stomach | 0.75 | 0.733333 | 0.767442 |
| CLDN18 AND CA9 | Stomach | 0.674699 | 0.7 | 0.651163 |
| CLDN18 AND SSTR5 | Stomach | 0.808989 | 0.782609 | 0.837209 |
| CLDN18 AND RNF43 | Stomach | 0.837209 | 0.837209 | 0.837209 |
| CLDN18 AND L1CAM | Stomach | 0.777778 | 0.744681 | 0.813953 |
| EPCAM AND SPON2 | Stomach | 0.931818 | 0.911111 | 0.953488 |
| CLDN18 AND CD19 | Stomach | 0.765957 | 0.705882 | 0.837209 |
| CLDN7 AND THY1 | Stomach | 0.926829 | 0.974359 | 0.883721 |
| CLDN18 AND IL2RA | Stomach | 0.781609 | 0.772727 | 0.790698 |
| CLDN18 AND TRPM4 | Stomach | 0.888889 | 0.947368 | 0.837209 |
| CLDN18 AND CLDN1 | Stomach | 0.9 | 0.972973 | 0.837209 |
| CLDN18 AND WT1 | Stomach | 0.765957 | 0.705882 | 0.837209 |
| CLDN18 AND SSTR3 | Stomach | 0.791209 | 0.75 | 0.837209 |
| CLDN18 AND BCAN | Stomach | 0.808989 | 0.782609 | 0.837209 |
| CLDN18 AND ERBB2 | Stomach | 0.888889 | 0.947368 | 0.837209 |
| CLDN18 AND PMEL | Stomach | 0.765957 | 0.705882 | 0.837209 |
| CLDN18 AND OAS1 | Stomach | 0.735294 | 1 | 0.581395 |
| CLDN18 AND SLC39A6 | Stomach | 0.86747 | 0.9 | 0.837209 |
| PTPRZ1 AND F2R | Astrocytoma | 0.866667 | 0.886364 | 0.847826 |
| PTPRZ1 AND BEST3 | Astrocytoma | 0.857143 | 0.866667 | 0.847826 |
| FAIM2 AND F2R | Astrocytoma | 0.840909 | 0.880952 | 0.804348 |
| PLP1 AND F2R | Astrocytoma | 0.831461 | 0.860465 | 0.804348 |
| CRB1 AND ABCA1 | Astrocytoma | 0.822222 | 0.840909 | 0.804348 |
| NRCAM AND F2R | Astrocytoma | 0.813953 | 0.875 | 0.76087 |
| NKAIN4 AND PTPRZ1 | Astrocytoma | 0.809524 | 0.894737 | 0.73913 |
| MLC1 AND HAS2 | Astrocytoma | 0.804598 | 0.853659 | 0.76087 |
| PTPRZ1 AND CD82 | Astrocytoma | 0.804348 | 0.804348 | 0.804348 |
| SLC1A2 AND VANGL2 | Astrocytoma | 0.804124 | 0.764706 | 0.847826 |
| KCNJ10 AND TSPAN11 | Astrocytoma | 0.8 | 0.818182 | 0.782609 |
| KCNJ10 AND VANGL2 | Astrocytoma | 0.8 | 0.818182 | 0.782609 |
| PTPRZ1 AND FXYD6 | Astrocytoma | 0.8 | 0.740741 | 0.869565 |
| GABBR2 AND VANGL2 | Astrocytoma | 0.795699 | 0.787234 | 0.804348 |
| PTPRZ1 AND GALR1 | Astrocytoma | 0.795699 | 0.787234 | 0.804348 |
| PTPRZ1 AND STAB1 | Astrocytoma | 0.791667 | 0.76 | 0.826087 |
| PTPRZ1 AND SYT6 | Astrocytoma | 0.791667 | 0.76 | 0.826087 |
| CRB1 AND ITGB8 | Astrocytoma | 0.791209 | 0.8 | 0.782609 |
| SLCO1C1 AND ABCA1 | Astrocytoma | 0.790698 | 0.85 | 0.73913 |
| GPM6B AND BEST3 | Astrocytoma | 0.790123 | 0.914286 | 0.695652 |
| ADAM22 AND F2R | Astrocytoma | 0.786517 | 0.813953 | 0.76087 |
| NRCAM AND SEMA4B | Astrocytoma | 0.786517 | 0.813953 | 0.76087 |
| MLC1 AND ABCA1 | Astrocytoma | 0.785714 | 0.868421 | 0.717391 |
| PLP1 AND BEST3 | Astrocytoma | 0.78481 | 0.939394 | 0.673913 |
| NKAIN4 AND ABCA1 | Astrocytoma | 0.781609 | 0.829268 | 0.73913 |
| PTPRZ1 AND SLC10A1 | Astrocytoma | 0.78 | 0.722222 | 0.847826 |
| CRB1 AND VANGL2 | Astrocytoma | 0.778947 | 0.755102 | 0.804348 |
| MLC1 AND BMPR1A | Astrocytoma | 0.777778 | 0.795455 | 0.76087 |
| CRB1 AND DLL1 | Astrocytoma | 0.777778 | 0.795455 | 0.76087 |
| CRB1 AND CALCRL | Astrocytoma | 0.776471 | 0.846154 | 0.717391 |
| NKAIN4 AND SNAP23 | Astrocytoma | 0.776471 | 0.846154 | 0.717391 |
| CRB1 AND ITM2B | Astrocytoma | 0.776471 | 0.846154 | 0.717391 |
| TTYH2 AND VANGL2 | Astrocytoma | 0.774194 | 0.765957 | 0.782609 |

FIG. 8 (Cont.)

| Antigen Pair Logic | Cancer (short name) | F1 | Precision | Recall |
|---|---|---|---|---|
| EPHA3 AND CLDN10 | Pancreas | 0.625 | 1 | 0.454545 |
| FAP AND GRM4 | Pancreas | 0.625 | 1 | 0.454545 |
| FAP AND NMBR | Pancreas | 0.842105 | 1 | 0.727273 |
| FAP AND CRB1 | Pancreas | 0.842105 | 1 | 0.727273 |
| FAP AND EFNB2 | Pancreas | 0.777778 | 1 | 0.636364 |
| FAP AND ICAM1 | Pancreas | 0.842105 | 1 | 0.727273 |
| FAP AND CCKAR | Pancreas | 0.705882 | 1 | 0.545455 |
| EPHA3 AND CD58 | Pancreas | 0.736842 | 0.875 | 0.636364 |
| FAP AND KCNU1 | Pancreas | 0.842105 | 1 | 0.727273 |
| FAP AND SLC6A18 | Pancreas | 0.777778 | 1 | 0.636364 |
| FAP AND PPAPDC1A | Pancreas | 0.777778 | 1 | 0.636364 |
| FAP AND OTOF | Pancreas | 0.842105 | 1 | 0.727273 |
| FAP AND KCNV2 | Pancreas | 0.842105 | 1 | 0.727273 |
| FAP AND SLC2A2 | Pancreas | 0.842105 | 1 | 0.727273 |
| FAP AND MEGF11 | Pancreas | 0.842105 | 1 | 0.727273 |
| FAP AND DPP10 | Pancreas | 0.705882 | 1 | 0.545455 |
| SLC30A8 AND CD52 | Pancreas | 0.777778 | 1 | 0.636364 |
| CLDN2 AND KCND2 | Pancreas | 0.8 | 0.888889 | 0.727273 |
| EPHA3 AND LAMP5 | Pancreas | 0.777778 | 1 | 0.636364 |
| EPHA3 AND PTGIR | Pancreas | 0.736842 | 0.875 | 0.636364 |
| FAP AND KCNK12 | Pancreas | 0.705882 | 1 | 0.545455 |
| FAP AND CDH18 | Pancreas | 0.842105 | 1 | 0.727273 |
| FAP AND CD163 | Pancreas | 0.777778 | 1 | 0.636364 |
| FAP AND CATSPERD | Pancreas | 0.842105 | 1 | 0.727273 |
| FAP AND SLC17A1 | Pancreas | 0.842105 | 1 | 0.727273 |
| FAP AND GGTLC1 | Pancreas | 0.625 | 1 | 0.454545 |
| FAP AND OPRK1 | Pancreas | 0.705882 | 1 | 0.545455 |
| FAP AND IFNAR2 | Pancreas | 0.705882 | 1 | 0.545455 |
| FAP AND PPAPDC1B | Pancreas | 0.705882 | 1 | 0.545455 |
| FAP AND PCDHA6 | Pancreas | 0.777778 | 1 | 0.636364 |
| FAP AND EBP | Pancreas | 0.625 | 1 | 0.454545 |
| FAP AND CD58 | Pancreas | 0.842105 | 1 | 0.727273 |
| FAP AND SLC17A3 | Pancreas | 0.842105 | 1 | 0.727273 |
| FAP AND KCNJ6 | Pancreas | 0.842105 | 1 | 0.727273 |
| FAP AND SLC26A8 | Pancreas | 0.842105 | 1 | 0.727273 |
| FAP AND NPFFR1 | Pancreas | 0.777778 | 1 | 0.636364 |
| CLDN18 AND KCND2 | Pancreas | 0.631579 | 0.75 | 0.545455 |
| SLC30A8 AND GPNMB | Pancreas | 0.777778 | 1 | 0.636364 |
| FAP AND GPR22 | Pancreas | 0.777778 | 1 | 0.636364 |
| FAP AND SPAM1 | Pancreas | 0.705882 | 1 | 0.545455 |
| FAP AND FCAMR | Pancreas | 0.842105 | 1 | 0.727273 |
| FAP AND OR52D1 | Pancreas | 0.777778 | 1 | 0.636364 |
| FAP AND DIO1 | Pancreas | 0.842105 | 1 | 0.727273 |
| EPHA3 AND PTGER4 | Pancreas | 0.777778 | 1 | 0.636364 |
| FAP AND OR2L2 | Pancreas | 0.842105 | 1 | 0.727273 |
| FAP AND AJAP1 | Pancreas | 0.705882 | 1 | 0.545455 |
| EPHA3 AND HLA-DRB1 | Pancreas | 0.777778 | 1 | 0.636364 |
| FAP AND CLDN10 | Pancreas | 0.705882 | 1 | 0.545455 |
| FAP AND USH2A | Pancreas | 0.777778 | 1 | 0.636364 |
| FAP AND ZP4 | Pancreas | 0.842105 | 1 | 0.727273 |
| FAP AND OPRM1 | Pancreas | 0.842105 | 1 | 0.727273 |
| FAP AND SLC12A5 | Pancreas | 0.842105 | 1 | 0.727273 |
| FAP AND TNFRSF12A | Pancreas | 0.842105 | 1 | 0.727273 |
| FAP AND GPR83 | Pancreas | 0.842105 | 1 | 0.727273 |
| FAP AND CHRNA1 | Pancreas | 0.842105 | 1 | 0.727273 |
| VCAM1 AND GGTLC1 | Renal | 0.8 | 1 | 0.666667 |
| VCAM1 AND FAT1 | Renal | 0.8 | 1 | 0.666667 |
| VCAM1 AND SLC22A5 | Renal | 0.736842 | 1 | 0.583333 |
| VCAM1 AND SLC22A18 | Renal | 0.8 | 1 | 0.666667 |
| CLDN2 AND GYPC | Renal | 0.727273 | 0.8 | 0.666667 |
| CLDN2 AND EMP3 | Renal | 0.727273 | 0.8 | 0.666667 |
| VCAM1 AND CLDN10 | Renal | 0.8 | 1 | 0.666667 |
| CLDN2 AND SLC38A1 | Renal | 0.736842 | 1 | 0.583333 |
| SLC22A2 AND VCAM1 | Renal | 0.7 | 0.875 | 0.583333 |
| CLDN2 AND LAPTM5 | Renal | 0.8 | 1 | 0.666667 |
| SLC17A1 AND VCAM1 | Renal | 0.666667 | 1 | 0.5 |
| VCAM1 AND SLC6A12 | Renal | 0.666667 | 1 | 0.5 |
| VCAM1 AND SLC22A11 | Renal | 0.666667 | 1 | 0.5 |
| CLDN2 AND P2RX4 | Renal | 0.727273 | 0.8 | 0.666667 |
| CLDN2 AND GPR137B | Renal | 0.64 | 0.615385 | 0.666667 |
| SLC13A1 AND VCAM1 | Renal | 0.631579 | 0.857143 | 0.5 |
| SLC6A13 AND VCAM1 | Renal | 0.631579 | 0.857143 | 0.5 |
| VCAM1 AND TNFRSF12A | Renal | 0.666667 | 1 | 0.5 |
| CLDN2 AND VANGL1 | Renal | 0.636364 | 0.7 | 0.583333 |
| VCAM1 AND ABCA12 | Renal | 0.666667 | 0.6 | 0.75 |
| VCAM1 AND TRPM3 | Renal | 0.631579 | 0.857143 | 0.5 |
| CLDN2 AND CD58 | Renal | 0.695652 | 0.727273 | 0.666667 |
| PTPRZ1 AND CD44 | Astrocytoma | 0.773333 | 1 | 0.630435 |
| NRCAM AND BEST3 | Astrocytoma | 0.772727 | 0.809524 | 0.73913 |
| SLCO1C1 AND CALCRL | Astrocytoma | 0.771084 | 0.864865 | 0.695652 |
| PCDH10 AND BEST3 | Astrocytoma | 0.771084 | 0.864865 | 0.695652 |
| CRB1 AND ABCC4 | Astrocytoma | 0.771084 | 0.864865 | 0.695652 |
| SLCO1C1 AND F2RL1 | Astrocytoma | 0.771084 | 0.864865 | 0.695652 |
| NKAIN4 AND WLS | Astrocytoma | 0.771084 | 0.864865 | 0.695652 |
| MLC1 AND VANGL2 | Astrocytoma | 0.769231 | 0.777778 | 0.76087 |
| GPM6A AND F2R | Astrocytoma | 0.769231 | 0.777778 | 0.76087 |
| ADCYAP1R1 AND BEST3 | Astrocytoma | 0.767442 | 0.825 | 0.717391 |
| PTPRZ1 AND CLDN17 | Astrocytoma | 0.766355 | 0.672131 | 0.891304 |
| NKAIN4 AND SLC25A3 | Astrocytoma | 0.765432 | 0.885714 | 0.673913 |
| ADAM12 AND PPAPDC1A | Breast | 0.830189 | 0.846154 | 0.814815 |
| ADAM12 AND SORL1 | Breast | 0.815534 | 0.857143 | 0.777778 |
| ADAM12 AND LAMP5 | Breast | 0.807339 | 0.8 | 0.814815 |
| ADAM12 AND LRRC8E | Breast | 0.787879 | 0.866667 | 0.722222 |
| ADAM12 AND VANGL1 | Breast | 0.783505 | 0.883721 | 0.703704 |
| BST2 AND PPAP2C | Breast | 0.777778 | 0.972222 | 0.648148 |
| ADAM12 AND MEGF10 | Breast | 0.77551 | 0.863636 | 0.703704 |
| ADAM12 AND UNC5A | Breast | 0.770833 | 0.880952 | 0.685185 |
| SLC5A6 AND KCNA4 | Breast | 0.777778 | 0.972222 | 0.648148 |
| PRLR AND FLVCR1 | Breast | 0.76087 | 0.921053 | 0.648148 |
| ADAM12 AND NKAIN1 | Breast | 0.757895 | 0.878049 | 0.666667 |
| SLC5A6 AND ADAM29 | Breast | 0.777778 | 0.972222 | 0.648148 |
| SLC5A6 AND SLC10A1 | Breast | 0.777778 | 0.972222 | 0.648148 |
| SLC5A6 AND SLC22A14 | Breast | 0.777778 | 0.972222 | 0.648148 |
| SLC5A6 AND GLRA2 | Breast | 0.777778 | 0.972222 | 0.648148 |
| PPAPDC1A AND MFSD10 | Breast | 0.744186 | 1 | 0.592593 |
| BST2 AND PROM2 | Breast | 0.782609 | 0.947368 | 0.666667 |
| PPAPDC1A AND FXYD3 | Breast | 0.787234 | 0.925 | 0.685185 |
| PPAPDC1A AND F11R | Breast | 0.744681 | 0.875 | 0.648148 |
| PPAPDC1A AND PROM2 | Breast | 0.755102 | 0.840909 | 0.685185 |
| PPAPDC1A AND SLC52A2 | Breast | 0.786517 | 1 | 0.648148 |
| CELSR2 AND BST2 | Breast | 0.736842 | 0.853659 | 0.648148 |
| SLC5A6 AND SCN10A | Breast | 0.777778 | 0.972222 | 0.648148 |
| SLC5A6 AND MIP | Breast | 0.735632 | 0.969697 | 0.592593 |
| ADAM12 AND CNIH2 | Breast | 0.734694 | 0.818182 | 0.666667 |
| PPAPDC1A AND LSR | Breast | 0.733333 | 0.916667 | 0.611111 |
| PRLR AND CXCL16 | Breast | 0.73913 | 0.894737 | 0.62963 |
| SLC5A6 AND SLC10A2 | Breast | 0.764045 | 0.971429 | 0.62963 |
| SLC5A6 AND KCND2 | Breast | 0.777778 | 0.972222 | 0.648148 |
| PPAPDC1A AND PLP2 | Breast | 0.744186 | 1 | 0.592593 |
| PPAPDC1A AND CDH1 | Breast | 0.744681 | 0.875 | 0.648148 |
| PPAPDC1A AND CALHM2 | Breast | 0.741573 | 0.942857 | 0.611111 |
| PPAPDC1A AND EDNRA | Breast | 0.782609 | 0.947368 | 0.666667 |
| PRLR AND IL17RA | Breast | 0.731183 | 0.871795 | 0.62963 |
| PPAPDC1A AND TCIRG1 | Breast | 0.755556 | 0.944444 | 0.62963 |
| SLC5A6 AND OR1C1 | Breast | 0.735632 | 0.969697 | 0.592593 |
| SLC5A6 AND PPAPDC1A | Breast | 0.729412 | 1 | 0.574074 |
| SLC5A6 AND LRRC8E | Breast | 0.729412 | 1 | 0.574074 |
| PPAPDC1A AND TNFSF10 | Breast | 0.730769 | 0.76 | 0.703704 |
| SLC5A6 AND CLDN19 | Breast | 0.735632 | 0.969697 | 0.592593 |
| SLC5A6 AND GPR19 | Breast | 0.755556 | 0.944444 | 0.62963 |
| PPAPDC1A AND SEC1M1 | Breast | 0.747253 | 0.918919 | 0.62963 |
| PPAPDC1A AND NOX4 | Breast | 0.76 | 0.826087 | 0.703704 |
| PPAPDC1A AND PLXND1 | Breast | 0.744186 | 1 | 0.592593 |
| MFSD10 AND CDH11 | Breast | 0.735632 | 0.969697 | 0.592593 |
| SLC2A2 AND FGFRL1 | Liver | 1 | 1 | 1 |
| FGG AND FGF6 | Liver | 0.909091 | 1 | 0.833333 |
| SLCO1B1 AND SLC26A6 | Liver | 0.923077 | 0.857143 | 1 |
| SLC2A2 AND CELSR3 | Liver | 0.857143 | 0.75 | 1 |
| SLC2A2 AND CNNM3 | Liver | 0.857143 | 0.75 | 1 |
| FGG AND SLC22A5 | Liver | 0.833333 | 0.833333 | 0.833333 |
| SLC2A2 AND TREML2 | Liver | 0.909091 | 1 | 0.833333 |
| SLC2A2 AND SLC38A6 | Liver | 0.909091 | 1 | 0.833333 |
| SLC2A2 AND PANX2 | Liver | 1 | 1 | 1 |
| SLC2A2 AND SLC26A6 | Liver | 1 | 1 | 1 |
| SLC17A2 AND SLC26A6 | Liver | 0.833333 | 0.833333 | 0.833333 |
| SLC2A2 AND ANO8 | Liver | 0.833333 | 0.833333 | 0.833333 |
| SLC2A2 AND ABCB8 | Liver | 0.909091 | 1 | 0.833333 |
| FGG AND ALCAM | Liver | 1 | 1 | 1 |
| FGG AND KCNJ6 | Liver | 0.909091 | 1 | 0.833333 |
| ABCG5 AND FGFRL1 | Liver | 1 | 1 | 1 |
| SLCO1B1 AND HM13 | Liver | 1 | 1 | 1 |
| SLC2A2 AND BCAM | Liver | 0.909091 | 1 | 0.833333 |
| SLC2A2 AND TP53I13 | Liver | 1 | 1 | 1 |
| SLC2A2 AND NPBWR2 | Liver | 0.909091 | 1 | 0.833333 |

FIG. 8 (Cont.)

| Antigen Pair Logic | Cancer (short name) | F1 | Precision | Recall |
|---|---|---|---|---|
| VCAM1 AND SLC38A1 | Renal | 0.615385 | 0.571429 | 0.666667 |
| CLDN2 AND ABCG4 | Renal | 0.615385 | 0.571429 | 0.666667 |
| CLDN2 AND CD44 | Renal | 0.666667 | 0.666667 | 0.666667 |
| CLDN2 AND HLA-DRB1 | Renal | 0.761905 | 0.888889 | 0.666667 |
| VCAM1 AND EPHA8 | Renal | 0.615385 | 0.571429 | 0.666667 |
| CLDN2 AND ICAM1 | Renal | 0.666667 | 1 | 0.5 |
| VCAM1 AND CALHM3 | Renal | 0.666667 | 0.6 | 0.75 |
| VCAM1 AND LRRN4 | Renal | 0.666667 | 0.6 | 0.75 |
| SLC13A1 AND CD276 | Renal | 0.6 | 0.75 | 0.5 |
| SLC13A1 AND AXL | Renal | 0.6 | 0.75 | 0.5 |
| VCAM1 AND SLC2A1 | Renal | 0.636364 | 0.7 | 0.583333 |
| VCAM1 AND TNFRSF10B | Renal | 0.615385 | 0.571429 | 0.666667 |
| DPEP1 AND TGFBI | Colon | 1 | 1 | 1 |
| IFI6 AND CEACAM5 | Colon | 1 | 1 | 1 |
| CDH17 AND CLDN1 | Colon | 1 | 1 | 1 |
| IFI6 AND GUCY2C | Colon | 1 | 1 | 1 |
| GPA33 AND TGFBI | Colon | 0.909091 | 0.833333 | 1 |
| CLDN7 AND TGFBI | Colon | 0.909091 | 0.833333 | 1 |
| IFI6 AND GPA33 | Colon | 1 | 1 | 1 |
| CDH17 AND THY1 | Colon | 1 | 1 | 1 |
| MUC13 AND TGFBI | Colon | 0.909091 | 0.833333 | 1 |
| IFI6 AND MUC13 | Colon | 1 | 1 | 1 |
| CEACAM5 AND TGFBI | Colon | 0.909091 | 0.833333 | 1 |
| GUCY2C AND TGFBI | Colon | 0.909091 | 0.833333 | 1 |
| DPEP1 AND IFI6 | Colon | 1 | 1 | 1 |
| CLDN3 AND TGFBI | Colon | 0.909091 | 0.833333 | 1 |
| CDH17 AND SLC7A5 | Colon | 1 | 1 | 1 |
| IFI6 AND EPHB2 | Colon | 0.909091 | 0.833333 | 1 |
| CLDN2 AND TGFBI | Colon | 0.888889 | 1 | 0.8 |
| NOX1 AND CLDN1 | Colon | 1 | 1 | 1 |
| IFI6 AND STEAP1 | Colon | 1 | 1 | 1 |
| DPEP1 AND NOX1 | Colon | 1 | 1 | 1 |
| NOX1 AND THY1 | Colon | 1 | 1 | 1 |
| IFI6 AND CLDN3 | Colon | 1 | 1 | 1 |
| CDH17 AND FAP | Colon | 0.888889 | 1 | 0.8 |
| CXCL16 AND MUC13 | Esophagus | 0.782609 | 1 | 0.642857 |
| CDH17 AND CLDN1 | Esophagus | 0.928571 | 0.928571 | 0.928571 |
| SLCO1B3 AND EPCAM | Esophagus | 0.636364 | 0.875 | 0.5 |
| CXCL16 AND CEACAM5 | Esophagus | 0.782609 | 1 | 0.642857 |
| CDH17 AND MOK | Esophagus | 0.666667 | 1 | 0.5 |
| MUC17 AND CLDN1 | Esophagus | 0.88 | 1 | 0.785714 |
| SLCO1B3 AND SLC7A5 | Esophagus | 0.6 | 1 | 0.428571 |
| MUC13 AND BST2 | Esophagus | 0.6 | 1 | 0.428571 |
| SLCO1B3 AND BIRC5 | Esophagus | 0.636364 | 0.875 | 0.5 |
| CBX3 AND SLC2A1 | Esophagus | 0.695652 | 0.888889 | 0.571429 |
| CDH17 AND SPON2 | Esophagus | 0.685714 | 0.571429 | 0.857143 |
| SLCO1B3 AND MUC1 | Esophagus | 0.636364 | 0.875 | 0.5 |
| SLCO1B3 AND IL20RA | Esophagus | 0.636364 | 0.875 | 0.5 |
| CXCL16 AND GUCY2C | Esophagus | 0.727273 | 1 | 0.571429 |
| CBX3 AND EFNB2 | Esophagus | 0.695652 | 0.888889 | 0.571429 |
| CXCL16 AND EPCAM | Esophagus | 0.782609 | 1 | 0.642857 |
| LYPD1 AND CD33 | Glioblastoma | 0.764706 | 0.764706 | 0.764706 |
| MLC1 AND IL13RA1 | Glioblastoma | 0.717949 | 0.636364 | 0.823529 |
| LYPD1 AND CD180 | Glioblastoma | 0.702703 | 0.65 | 0.764706 |
| LYPD1 AND AXL | Glioblastoma | 0.848485 | 0.875 | 0.823529 |
| LYPD1 AND SLC7A5 | Glioblastoma | 0.7 | 0.608696 | 0.823529 |
| LYPD1 AND CD70 | Glioblastoma | 0.7 | 0.608696 | 0.823529 |
| LYPD1 AND CLDN5 | Glioblastoma | 0.7 | 0.608696 | 0.823529 |
| MLC1 AND VCAM1 | Glioblastoma | 0.742857 | 0.722222 | 0.764706 |
| CRB1 AND ITGAV | Glioblastoma | 0.692308 | 1 | 0.529412 |
| LYPD1 AND CSPG4 | Glioblastoma | 0.692308 | 1 | 0.529412 |
| LYPD1 AND IL13RA1 | Glioblastoma | 0.823529 | 0.823529 | 0.823529 |
| LYPD1 AND SLC39A6 | Glioblastoma | 0.684211 | 0.619048 | 0.764706 |
| MLC1 AND GPNMB | Glioblastoma | 0.709677 | 0.785714 | 0.647059 |
| LYPD1 AND BMPR1B | Glioblastoma | 0.717949 | 0.636364 | 0.823529 |
| LYPD1 AND NCAM1 | Glioblastoma | 0.666667 | 0.590909 | 0.764706 |
| LYPD1 AND MUC1 | Glioblastoma | 0.666667 | 0.9 | 0.529412 |
| SYT11 AND GPNMB | Glioblastoma | 0.666667 | 0.56 | 0.823529 |
| SYT11 AND ITGAV | Glioblastoma | 0.717949 | 0.636364 | 0.823529 |
| SLC1A2 AND IL13RA1 | Glioblastoma | 0.692308 | 1 | 0.529412 |
| MLC1 AND EGFR | Glioblastoma | 0.647059 | 0.647059 | 0.647059 |
| SYT11 AND MUC1 | Glioblastoma | 0.642857 | 0.818182 | 0.529412 |
| CDH10 AND MUC1 | Glioblastoma | 0.642857 | 0.818182 | 0.529412 |
| MLC1 AND ITGAV | Glioblastoma | 0.666667 | 0.769231 | 0.588235 |
| LYPD1 AND ITGAV | Glioblastoma | 0.740741 | 1 | 0.588235 |
| LYPD1 AND PROM1 | Glioblastoma | 0.631579 | 0.571429 | 0.705882 |
| GPR158 AND ITGAV | Glioblastoma | 0.666667 | 0.56 | 0.823529 |
| SLC2A2 AND TMEM67 | Liver | 0.857143 | 0.75 | 1 |
| SLCO1B1 AND ANO10 | Liver | 0.909091 | 1 | 0.833333 |
| ABCG5 AND SLC38A6 | Liver | 0.909091 | 1 | 0.833333 |
| HPN AND PLVAP | Liver | 0.8 | 1 | 0.666667 |
| FGG AND MLANA | Liver | 0.8 | 1 | 0.666667 |
| SLCO1B1 AND CELSR3 | Liver | 0.8 | 0.666667 | 1 |
| SLC2A2 AND SLC5A5 | Liver | 0.909091 | 1 | 0.833333 |
| FGG AND GPR158 | Liver | 0.8 | 0.666667 | 1 |
| ABCG5 AND SMO | Liver | 0.8 | 1 | 0.666667 |
| ASGR1 AND PLVAP | Liver | 0.8 | 1 | 0.666667 |
| SLCO1B1 AND C6orf89 | Liver | 1 | 1 | 1 |
| SLC2A2 AND DAGLB | Liver | 0.8 | 1 | 0.666667 |
| SLC2A2 AND SMO | Liver | 0.8 | 1 | 0.666667 |
| SLC2A2 AND HM13 | Liver | 1 | 1 | 1 |
| FGG AND SLC50A1 | Liver | 1 | 1 | 1 |
| SLC2A2 AND SLC4A11 | Liver | 0.8 | 1 | 0.666667 |
| SLCO1B1 AND SMO | Liver | 0.8 | 1 | 0.666667 |
| FGG AND PLVAP | Liver | 0.8 | 1 | 0.666667 |
| FGG AND NPFFR1 | Liver | 0.8 | 1 | 0.666667 |
| SLC2A2 AND PTCHD1 | Liver | 0.833333 | 0.833333 | 0.833333 |
| SLC2A2 AND PLXNC1 | Liver | 0.8 | 1 | 0.666667 |
| SLCO1B1 AND SLC4A11 | Liver | 0.833333 | 0.833333 | 0.833333 |
| SLCO1B1 AND CD200 | Liver | 0.923077 | 0.857143 | 1 |
| SLC2A2 AND KCNN3 | Liver | 0.909091 | 1 | 0.833333 |
| SLC2A2 AND CRHR1 | Liver | 0.8 | 1 | 0.666667 |
| SLC2A2 AND ATP2A2 | Liver | 0.909091 | 1 | 0.833333 |
| SLC2A2 AND NOTCH4 | Liver | 1 | 1 | 1 |
| FGG AND PCDHB1 | Liver | 0.8 | 0.666667 | 1 |
| SLCO1B1 AND DAGLB | Liver | 0.8 | 1 | 0.666667 |
| SLC2A2 AND SLC12A7 | Liver | 0.909091 | 1 | 0.833333 |
| SLCO1B1 AND TLCD1 | Liver | 1 | 1 | 1 |
| SLC17A2 AND HM13 | Liver | 0.909091 | 1 | 0.833333 |
| SLCO1B1 AND FGFRL1 | Liver | 1 | 1 | 1 |
| ABCB4 AND PLVAP | Liver | 0.8 | 1 | 0.666667 |
| SLC2A2 AND IGSF8 | Liver | 1 | 1 | 1 |
| SLC2A2 AND SLC39A1 | Liver | 0.909091 | 1 | 0.833333 |
| FGG AND DTNA | Liver | 0.909091 | 1 | 0.833333 |
| SLC2A2 AND TSPAN5 | Liver | 0.833333 | 0.833333 | 0.833333 |
| SLC2A2 AND QSOX2 | Liver | 0.909091 | 1 | 0.833333 |
| FGG AND SLC22A12 | Liver | 0.833333 | 0.833333 | 0.833333 |
| SLC13A5 AND SMO | Liver | 0.8 | 1 | 0.666667 |
| SLC2A2 AND C6orf89 | Liver | 1 | 1 | 1 |
| SLC2A2 AND SLC26A11 | Liver | 0.909091 | 1 | 0.833333 |
| SLCO1B1 AND SLC7A11 | Liver | 1 | 1 | 1 |
| SLCO1B1 AND NIPA1 | Liver | 0.909091 | 1 | 0.833333 |
| SLC2A2 AND MMP14 | Liver | 0.923077 | 0.857143 | 1 |
| SLC2A2 AND TIE1 | Liver | 0.857143 | 0.75 | 1 |
| SLCO1B1 AND SLC38A6 | Liver | 0.909091 | 1 | 0.833333 |
| SLCO1B1 AND SLC39A1 | Liver | 0.909091 | 1 | 0.833333 |
| SLCO1B1 AND NPBWR2 | Liver | 0.909091 | 1 | 0.833333 |
| ABCG5 AND CELSR3 | Liver | 0.923077 | 0.857143 | 1 |
| ABCC6 AND PLVAP | Liver | 0.8 | 1 | 0.666667 |
| SLCO1B1 AND NCSTN | Liver | 1 | 1 | 1 |
| SLC2A2 AND SLC16A11 | Liver | 0.833333 | 0.833333 | 0.833333 |
| SLCO1B1 AND TP53I13 | Liver | 0.923077 | 0.857143 | 1 |
| ASGR1 AND FGF6 | Liver | 0.833333 | 0.833333 | 0.833333 |
| SLCO1B1 AND TREML2 | Liver | 0.909091 | 1 | 0.833333 |
| SLC27A5 AND PLVAP | Liver | 0.8 | 1 | 0.666667 |
| SLCO1B1 AND PANX2 | Liver | 1 | 1 | 1 |
| SLCO1B1 AND LRRC8D | Liver | 0.909091 | 1 | 0.833333 |
| SLCO1B1 AND ABCB8 | Liver | 0.857143 | 0.75 | 1 |
| SLC17A2 AND ANO10 | Liver | 0.8 | 1 | 0.666667 |
| TNFRSF12A AND ADAM28 | Pancreas | 0.777778 | 1 | 0.636364 |
| KCNE4 AND IFNAR2 | Pancreas | 0.666667 | 0.615385 | 0.727273 |
| SYT13 AND EMP3 | Pancreas | 0.8 | 0.888889 | 0.727273 |
| NOX4 AND TNFRSF10B | Pancreas | 0.666667 | 0.7 | 0.636364 |
| PTGIS AND GJB1 | Pancreas | 0.666667 | 0.615385 | 0.727273 |
| NOX4 AND TNFRSF12A | Pancreas | 0.636364 | 0.636364 | 0.636364 |
| KCNE4 AND TNFRSF12A | Pancreas | 0.636364 | 0.636364 | 0.636364 |
| TNFRSF12A AND TNFSF4 | Pancreas | 0.705882 | 1 | 0.545455 |
| NOX4 AND UMODL1 | Pancreas | 0.72 | 0.642857 | 0.818182 |
| SYT13 AND BST2 | Pancreas | 0.842105 | 1 | 0.727273 |
| SYT13 AND PTGIS | Pancreas | 0.628571 | 0.458333 | 1 |
| NOX4 AND LAPTM5 | Pancreas | 0.625 | 1 | 0.454545 |
| NOX4 AND CD58 | Pancreas | 0.705882 | 1 | 0.545455 |
| CLDN10 AND CXCR4 | Pancreas | 0.705882 | 1 | 0.545455 |
| GP2 AND PTGIS | Pancreas | 0.8 | 0.888889 | 0.727273 |

FIG. 8 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NCAM1 AND PPAPDC1B | Glioblastoma | 0.645161 | 0.714286 | 0.588235 | GP2 AND CDH11 | Pancreas | 0.777778 | 1 | 0.636364 |
| SLCO1C1 AND IL13RA1 | Glioblastoma | 0.625 | 0.483871 | 0.882353 | SLC30A8 AND VMP1 | Pancreas | 0.705882 | 1 | 0.545455 |
| BEST3 AND BMPR1B | Glioblastoma | 0.625 | 0.666667 | 0.588235 | GP2 AND BST2 | Pancreas | 0.705882 | 1 | 0.545455 |
| SLCO1C1 AND MUC1 | Glioblastoma | 0.62069 | 0.75 | 0.529412 | NOX4 AND PCDHA6 | Pancreas | 0.64 | 0.571429 | 0.727273 |
| CRB1 AND VCAM1 | Glioblastoma | 0.611111 | 0.578947 | 0.647059 | GP2 AND F2R | Pancreas | 0.842105 | 1 | 0.727273 |
| SCN1A AND ITGAV | Glioblastoma | 0.666667 | 0.769231 | 0.588235 | GP2 AND LAMP5 | Pancreas | 0.705882 | 1 | 0.545455 |
| GPR19 AND ITGAV | Glioblastoma | 0.62069 | 0.75 | 0.529412 | NOX4 AND CD82 | Pancreas | 0.608696 | 0.583333 | 0.636364 |
| SLCO1C1 AND GPNMB | Glioblastoma | 0.684211 | 0.619048 | 0.764706 | KCNE4 AND LAPTM5 | Pancreas | 0.608696 | 0.583333 | 0.636364 |
| GPR158 AND GPNMB | Glioblastoma | 0.603774 | 0.444444 | 0.941176 | NOX4 AND NMBR | Pancreas | 0.72 | 0.642857 | 0.818182 |
| LYPD1 AND VCAM1 | Glioblastoma | 0.827586 | 1 | 0.705882 | GP2 AND CD163 | Pancreas | 0.842105 | 1 | 0.727273 |
| SLCO1C1 AND ITGAV | Glioblastoma | 0.742857 | 0.722222 | 0.764706 | KCNE4 AND HLA-DRB1 | Pancreas | 0.608696 | 0.583333 | 0.636364 |
| ASTN1 AND ITGAV | Glioblastoma | 0.666667 | 0.9 | 0.529412 | KCNE4 AND CD74 | Pancreas | 0.608696 | 0.583333 | 0.636364 |
| BMPR1B AND CD163 | Glioblastoma | 0.827586 | 1 | 0.705882 | SLC30A8 AND TM4SF1 | Pancreas | 0.705882 | 1 | 0.545455 |
| NCAM1 AND IFNAR2 | Glioblastoma | 0.666667 | 0.6875 | 0.647059 | GJB1 AND EMP3 | Pancreas | 0.666667 | 0.857143 | 0.545455 |
| SLCO1C1 AND CLDN12 | Glioblastoma | 0.615385 | 0.457143 | 0.941176 | TM4SF1 AND KCND2 | Pancreas | 0.666667 | 0.857143 | 0.545455 |
| PPAPDC1A AND ITGAV | Glioblastoma | 0.631579 | 0.571429 | 0.705882 | NOX4 AND KCNU1 | Pancreas | 0.6 | 0.473684 | 0.818182 |
| NCAM1 AND SLC31A1 | Glioblastoma | 0.689655 | 0.833333 | 0.588235 | NOX4 AND OTOF | Pancreas | 0.6 | 0.473684 | 0.818182 |
| SYT11 AND ITGAV | Glioma | 0.977778 | 1 | 0.956522 | GP2 AND CD93 | Pancreas | 0.777778 | 1 | 0.636364 |
| GPR158 AND ITGAV | Glioma | 0.948905 | 0.955882 | 0.942029 | TM4SF1 AND CACNG4 | Pancreas | 0.631579 | 0.75 | 0.545455 |
| KCNJ10 AND ITGAV | Glioma | 0.906475 | 0.9 | 0.913043 | GP2 AND LAPTM5 | Pancreas | 0.705882 | 1 | 0.545455 |
| SYT11 AND CLDN8 | Glioma | 0.957143 | 0.943662 | 0.971014 | OLR1 AND CEACAM7 | Pancreas | 0.705882 | 1 | 0.545455 |
| GPR19 AND ITGAV | Glioma | 0.913386 | 1 | 0.84058 | GP2 AND PPAPDC1A | Pancreas | 0.615385 | 0.533333 | 0.727273 |
| SYT11 AND FCRL5 | Glioma | 0.971429 | 0.957746 | 0.985507 | SLC30A8 AND PTPRK | Pancreas | 0.625 | 1 | 0.454545 |
| SYT11 AND CD276 | Glioma | 0.964029 | 0.957143 | 0.971014 | SLC30A8 AND CD9 | Pancreas | 0.777778 | 1 | 0.636364 |
| SYT11 AND ENG | Glioma | 0.964539 | 0.944444 | 0.985507 | GP2 AND HLA-DRB1 | Pancreas | 0.625 | 1 | 0.454545 |
| SYT11 AND GUCY2C | Glioma | 0.957143 | 0.943662 | 0.971014 | GP2 AND SLC6A6 | Pancreas | 0.636364 | 0.636364 | 0.636364 |
| SYT11 AND CLDN23 | Glioma | 0.964029 | 0.957143 | 0.971014 | NOX4 AND PTGIR | Pancreas | 0.736842 | 0.875 | 0.636364 |
| SYT11 AND EDNRB | Glioma | 0.942029 | 0.942029 | 0.942029 | GP2 AND PTGIR | Pancreas | 0.666667 | 0.857143 | 0.545455 |
| SYT11 AND FCRL1 | Glioma | 0.934307 | 0.941176 | 0.927536 | PTGIS AND TNFRSF21 | Pancreas | 0.666667 | 0.7 | 0.636364 |
| SYT11 AND CD37 | Glioma | 0.964539 | 0.944444 | 0.985507 | NOX4 AND LAMP5 | Pancreas | 0.8 | 0.888889 | 0.727273 |
| SYT11 AND ABCB5 | Glioma | 0.957143 | 0.943662 | 0.971014 | CLDN10 AND TNFSF13B | Pancreas | 0.625 | 1 | 0.454545 |
| SYT11 AND ITGB6 | Glioma | 0.957143 | 0.943662 | 0.971014 | CLDN10 AND SLAMF6 | Pancreas | 0.6 | 0.666667 | 0.545455 |
| SYT11 AND TNFRSF17 | Glioma | 0.957143 | 0.943662 | 0.971014 | GP2 AND PROCR | Pancreas | 0.625 | 1 | 0.454545 |
| SYT11 AND CD180 | Glioma | 0.964539 | 0.944444 | 0.985507 | TREM2 AND LAMP5 | Pancreas | 0.631579 | 0.75 | 0.545455 |
| SYT11 AND TNFSF11 | Glioma | 0.956522 | 0.956522 | 0.956522 | TNFRSF12A AND VSIG1 | Pancreas | 0.631579 | 0.75 | 0.545455 |
| SYT11 AND PTK7 | Glioma | 0.94964 | 0.942857 | 0.956522 | SLC30A8 AND S100A10 | Pancreas | 0.777778 | 1 | 0.636364 |
| SYT11 AND SDC1 | Glioma | 0.942029 | 0.942029 | 0.942029 | CDH6 AND GYPC | Renal | 0.857143 | 1 | 0.75 |
| SYT11 AND ULBP1 | Glioma | 0.948905 | 0.955882 | 0.942029 | CDH6 AND NOX1 | Renal | 0.857143 | 1 | 0.75 |
| SYT11 AND VTCN1 | Glioma | 0.94964 | 0.942857 | 0.956522 | CDH6 AND P2RX4 | Renal | 0.857143 | 1 | 0.75 |
| SYT11 AND SSTR4 | Glioma | 0.94964 | 0.942857 | 0.956522 | CDH6 AND IL13 | Renal | 0.857143 | 1 | 0.75 |
| ASTN1 AND ITGAV | Glioma | 0.888889 | 0.982456 | 0.811594 | CDH6 AND CLDN15 | Renal | 0.857143 | 1 | 0.75 |
| SYT11 AND IL2RA | Glioma | 0.964539 | 0.944444 | 0.985507 | CDH6 AND HLA-DRB1 | Renal | 0.857143 | 1 | 0.75 |
| SYT11 AND CD72 | Glioma | 0.957143 | 0.943662 | 0.971014 | CDH6 AND ABCA12 | Renal | 0.857143 | 1 | 0.75 |
| SYT11 AND CLDN2 | Glioma | 0.94964 | 0.942857 | 0.956522 | CDH6 AND C8B | Renal | 0.857143 | 1 | 0.75 |
| SYT11 AND SLC34A2 | Glioma | 0.942029 | 0.942029 | 0.942029 | CDH6 AND SLC22A14 | Renal | 0.857143 | 1 | 0.75 |
| SYT11 AND MUC4 | Glioma | 0.964539 | 0.944444 | 0.985507 | JPH1 AND TGFBI | Colon | 1 | 1 | 1 |
| SYT11 AND SSTR3 | Glioma | 0.964539 | 0.944444 | 0.985507 | IFI6 AND HEPH | Colon | 1 | 1 | 1 |
| SYT11 AND CD52 | Glioma | 0.964029 | 0.957143 | 0.971014 | CDH17 AND SLC39A10 | Colon | 1 | 1 | 1 |
| CDH10 AND ITGAV | Glioma | 0.878049 | 1 | 0.782609 | NOX1 AND AMIGO2 | Colon | 0.909091 | 0.833333 | 1 |
| SYT11 AND SLC39A6 | Glioma | 0.956522 | 0.956522 | 0.956522 | IFI6 AND SLC39A4 | Colon | 1 | 1 | 1 |
| SYT11 AND KDR | Glioma | 0.964539 | 0.944444 | 0.985507 | IFI6 AND GPR160 | Colon | 0.909091 | 0.833333 | 1 |
| SYT11 AND CR2 | Glioma | 0.94964 | 0.942857 | 0.956522 | IFI6 AND MEP1A | Colon | 1 | 1 | 1 |
| SYT11 AND MS4A1 | Glioma | 0.957143 | 0.943662 | 0.971014 | IFI6 AND IHH | Colon | 1 | 1 | 1 |
| SYT11 AND MSLN | Glioma | 0.964539 | 0.944444 | 0.985507 | CDH17 AND AMIGO2 | Colon | 0.909091 | 0.833333 | 1 |
| SYT11 AND CD33 | Glioma | 0.964539 | 0.944444 | 0.985507 | ATP10B AND TGFBI | Colon | 0.909091 | 0.833333 | 1 |
| SYT11 AND CLDN18 | Glioma | 0.918519 | 0.939394 | 0.898551 | MEP1A AND TGFBI | Colon | 0.909091 | 0.833333 | 1 |
| SYT11 AND AXL | Glioma | 0.957143 | 0.943662 | 0.971014 | IFI6 AND CFTR | Colon | 1 | 1 | 1 |
| SYT11 AND IL3RA | Glioma | 0.957143 | 0.943662 | 0.971014 | IFI6 AND SLC26A3 | Colon | 1 | 1 | 1 |
| SYT11 AND CD34 | Glioma | 0.964539 | 0.944444 | 0.985507 | HEPH AND TGFBI | Colon | 0.909091 | 0.833333 | 1 |
| SYT11 AND ROR1 | Glioma | 0.964539 | 0.944444 | 0.985507 | IFI6 AND ATP10B | Colon | 1 | 1 | 1 |
| SYT11 AND FCRL2 | Glioma | 0.957143 | 0.943662 | 0.971014 | IFI6 AND SLC5A1 | Colon | 1 | 1 | 1 |
| SYT11 AND MUC16 | Glioma | 0.964539 | 0.944444 | 0.985507 | IFI6 AND CEACAM1 | Colon | 0.909091 | 0.833333 | 1 |
| SYT11 AND RNF43 | Glioma | 0.957143 | 0.943662 | 0.971014 | IYD AND TGFBI | Colon | 0.909091 | 0.833333 | 1 |
| SYT11 AND GPA33 | Glioma | 0.957143 | 0.943662 | 0.971014 | TM4SF5 AND TGFBI | Colon | 0.909091 | 0.833333 | 1 |
| SYT11 AND RAET1E | Glioma | 0.964539 | 0.944444 | 0.985507 | NOX1 AND SLC39A10 | Colon | 1 | 1 | 1 |
| SYT11 AND CA9 | Glioma | 0.957143 | 0.943662 | 0.971014 | IFI6 AND ATP1A1 | Colon | 0.888889 | 1 | 0.8 |
| SYT11 AND TNFRSF10A | Glioma | 0.94964 | 0.942857 | 0.956522 | IFI6 AND SLC35G1 | Colon | 1 | 1 | 1 |
| SYT11 AND MST1R | Glioma | 0.948905 | 0.955882 | 0.942029 | IFI6 AND IYD | Colon | 0.909091 | 0.833333 | 1 |
| SYT11 AND SSTR5 | Glioma | 0.94964 | 0.942857 | 0.956522 | SLC26A3 AND TGFBI | Colon | 0.909091 | 0.833333 | 1 |
| SYT11 AND PMEL | Glioma | 0.964539 | 0.944444 | 0.985507 | IFI6 AND TM4SF5 | Colon | 1 | 1 | 1 |
| SYT11 AND SLAMF7 | Glioma | 0.964539 | 0.944444 | 0.985507 | NOX1 AND TACSTD2 | Colon | 1 | 1 | 1 |
| SYT11 AND CXCR5 | Glioma | 0.957143 | 0.943662 | 0.971014 | IFI6 AND JPH1 | Colon | 1 | 1 | 1 |
| OMG AND ITGAV | Glioma | 0.867133 | 0.837838 | 0.898551 | FUT3 AND SLC39A10 | Colon | 1 | 1 | 1 |
| SYT11 AND TNFRSF13C | Glioma | 0.964539 | 0.944444 | 0.985507 | IFI6 AND XK | Colon | 0.909091 | 0.833333 | 1 |
| SYT11 AND CD38 | Glioma | 0.964539 | 0.944444 | 0.985507 | IFI6 AND TSPAN8 | Colon | 1 | 1 | 1 |
| SYT11 AND IL20RA | Glioma | 0.94964 | 0.942857 | 0.956522 | IFI6 AND ST14 | Colon | 1 | 1 | 1 |
| SYT11 AND CLDN9 | Glioma | 0.957143 | 0.943662 | 0.971014 | IFI6 AND PTPRH | Colon | 0.833333 | 0.714286 | 1 |

FIG. 8 (Cont.)

| Antigen Pair Logic | Cancer (short name) | F1 | Precision | Recall |
|---|---|---|---|---|
| SYT11 AND CD79A | Glioma | 0.964539 | 0.944444 | 0.985507 |
| SCN1A AND ITGAV | Glioma | 0.90625 | 0.983051 | 0.84058 |
| SYT11 AND LGR5 | Glioma | 0.942029 | 0.942029 | 0.942029 |
| ITGAV AND SLC4A8 | Glioma | 0.882353 | 0.895522 | 0.869565 |
| SYT11 AND VCAM1 | Glioma | 0.957143 | 0.943662 | 0.971014 |
| SYT11 AND FOLR1 | Glioma | 0.964539 | 0.944444 | 0.985507 |
| SYT11 AND MUC13 | Glioma | 0.964539 | 0.944444 | 0.985507 |
| SYT11 AND CLDN1 | Glioma | 0.964539 | 0.944444 | 0.985507 |
| SYT11 AND CD70 | Glioma | 0.956522 | 0.956522 | 0.956522 |
| SYT11 AND EGFR | Glioma | 0.875 | 0.949153 | 0.811594 |
| SYT11 AND CD79B | Glioma | 0.918519 | 0.939394 | 0.898551 |
| ITGAV AND SORL1 | Glioma | 0.916031 | 0.967742 | 0.869565 |
| SYT11 AND ENPP3 | Glioma | 0.926471 | 0.940299 | 0.913043 |
| GPR158 AND SLC39A6 | Glioma | 0.852941 | 0.865672 | 0.84058 |
| GPR19 AND EDNRB | Glioma | 0.878788 | 0.920635 | 0.84058 |
| SYT11 AND CSPG4 | Glioma | 0.850394 | 0.931034 | 0.782609 |
| LYPD1 AND ITGAV | Glioma | 0.904762 | 1 | 0.826087 |
| NCAM1 AND LAPTM5 | Glioma | 0.873016 | 0.964912 | 0.797101 |
| SCN2A AND ITGAV | Glioma | 0.883721 | 0.95 | 0.826087 |
| ITGAV AND CNIH2 | Glioma | 0.880597 | 0.907692 | 0.855072 |
| MLC1 AND ITGAV | Glioma | 0.83871 | 0.945455 | 0.753623 |
| GPR19 AND SLC39A6 | Glioma | 0.836066 | 0.962264 | 0.73913 |
| FXYD6 AND ITGAV | Glioma | 0.840336 | 1 | 0.724638 |
| SLC22A16 AND CD37 | AML | 0.924949 | 0.942149 | 0.908367 |
| SLC22A16 AND SLC7A5 | AML | 0.901734 | 0.873134 | 0.932271 |
| SLC22A16 AND P2RX5 | AML | 0.874751 | 0.873016 | 0.876494 |
| SLC22A16 AND ENG | AML | 0.859504 | 0.892704 | 0.828685 |
| SLC22A16 AND IL11RA | AML | 0.824268 | 0.867841 | 0.784861 |
| CD37 AND SLC43A1 | AML | 0.772182 | 0.96988 | 0.641434 |
| TTYH3 AND CD276 | Liposarcoma | 0.638889 | 0.638889 | 0.638889 |
| TTYH3 AND GPNMB | Liposarcoma | 0.637681 | 0.666667 | 0.611111 |
| TTYH3 AND PTK7 | Liposarcoma | 0.608696 | 0.636364 | 0.583333 |
| ROR1 AND ESAM | Liposarcoma | 0.6 | 0.75 | 0.5 |
| ROR1 AND PLVAP | Liposarcoma | 0.6 | 0.75 | 0.5 |
| EPHB2 AND GYPC | Liposarcoma | 0.746988 | 0.659574 | 0.861111 |
| EPHB2 AND CD93 | Liposarcoma | 0.697674 | 0.6 | 0.833333 |
| EMP3 AND FOLH1 | Liposarcoma | 0.722222 | 0.722222 | 0.722222 |
| STAB1 AND GPNMB | Liposarcoma | 0.705882 | 0.75 | 0.666667 |
| EMP3 AND EPHB2 | Liposarcoma | 0.72 | 0.692308 | 0.75 |
| CD163 AND EPHB2 | Liposarcoma | 0.694444 | 0.694444 | 0.694444 |
| ATP8B2 AND EPHB2 | Liposarcoma | 0.676923 | 0.758621 | 0.611111 |
| EPHB2 AND PHLDB2 | Liposarcoma | 0.641975 | 0.577778 | 0.722222 |
| CD163 AND CD276 | Liposarcoma | 0.717949 | 0.666667 | 0.777778 |
| STAB1 AND TPBG | Liposarcoma | 0.603175 | 0.703704 | 0.527778 |
| SLC6A7 AND EPHB2 | Liposarcoma | 0.675325 | 0.634146 | 0.722222 |
| EPHB2 AND TGFBI | Liposarcoma | 0.657143 | 0.676471 | 0.638889 |
| SLC34A2 AND SLC50A1 | Lung Adenocarcinoma | 0.612613 | 0.829268 | 0.485714 |
| EPCAM AND CD93 | Lung Adenocarcinoma | 0.601504 | 0.634921 | 0.571429 |
| SLC34A2 AND S1PR1 | Lung Adenocarcinoma | 0.614458 | 0.53125 | 0.728571 |
| EPCAM AND CD163 | Lung Adenocarcinoma | 0.608 | 0.690909 | 0.542857 |
| SLC34A2 AND ESAM | Lung Adenocarcinoma | 0.608696 | 0.538462 | 0.7 |
| CD163 AND CLDN7 | Lung Adenocarcinoma | 0.62069 | 0.782609 | 0.514286 |
| SLC34A2 AND DYSF | Lung Adenocarcinoma | 0.604938 | 0.532609 | 0.7 |
| KCNJ10 AND GPNMB | B-Cell Diffuse | 0.739726 | 0.75 | 0.72973 |
| CD79B AND KCNJ10 | B-Cell Diffuse | 0.727273 | 0.827586 | 0.648649 |
| CD180 AND KCNJ10 | B-Cell Diffuse | 0.722222 | 0.742857 | 0.702703 |
| CD79B AND SLC22A8 | B-Cell Diffuse | 0.716418 | 0.8 | 0.648649 |
| CD79B AND CDH11 | B-Cell Diffuse | 0.707692 | 0.821429 | 0.621622 |
| CD79B AND GJD2 | B-Cell Diffuse | 0.707692 | 0.821429 | 0.621622 |
| KCNJ10 AND CD52 | B-Cell Diffuse | 0.702703 | 0.702703 | 0.702703 |
| CD79B AND SLC22A14 | B-Cell Diffuse | 0.695652 | 0.75 | 0.648649 |
| KCNJ10 AND CD37 | B-Cell Diffuse | 0.684932 | 0.694444 | 0.675676 |
| CD79A AND KCNJ10 | B-Cell Diffuse | 0.685714 | 0.727273 | 0.648649 |
| CD79B AND FAT1 | B-Cell Diffuse | 0.676471 | 0.741935 | 0.621622 |
| CD72 AND KCNJ10 | B-Cell Diffuse | 0.676471 | 0.741935 | 0.621622 |
| CD79B AND CSPG5 | B-Cell Diffuse | 0.666667 | 0.71875 | 0.621622 |
| KCNJ10 AND CD38 | B-Cell Diffuse | 0.666667 | 0.657895 | 0.675676 |
| CD79A AND CDH11 | B-Cell Diffuse | 0.657534 | 0.666667 | 0.648649 |
| CD79B AND AOC3 | B-Cell Diffuse | 0.6875 | 0.814815 | 0.594595 |
| FCRL5 AND CSPG5 | B-Cell Diffuse | 0.686567 | 0.766667 | 0.621622 |
| KCNJ10 AND TNFRSF17 | B-Cell Diffuse | 0.658228 | 0.619048 | 0.702703 |
| CD72 AND CDH11 | B-Cell Diffuse | 0.637681 | 0.6875 | 0.594595 |
| CD180 AND CDH11 | B-Cell Diffuse | 0.675 | 0.627907 | 0.72973 |
| FCRL5 AND SLC22A8 | B-Cell Diffuse | 0.688525 | 0.875 | 0.567568 |
| CD72 AND AOC3 | B-Cell Diffuse | 0.626866 | 0.7 | 0.567568 |
| CD79B AND PLVAP | B-Cell Diffuse | 0.666667 | 0.807692 | 0.567568 |
| CD79B AND PROCR | B-Cell Diffuse | 0.622951 | 0.791667 | 0.513514 |

| Antigen Pair Logic | Cancer (short name) | F1 | Precision | Recall |
|---|---|---|---|---|
| CDH17 AND GJA4 | Colon | 0.888889 | 1 | 0.8 |
| CDH17 AND PODXL | Colon | 0.888889 | 1 | 0.8 |
| CDH17 AND TMED1 | Colon | 0.888889 | 1 | 0.8 |
| CDH17 AND IL1RAP | Colon | 0.888889 | 1 | 0.8 |
| CDH17 AND LDLRAD3 | Colon | 0.888889 | 1 | 0.8 |
| IFI6 AND DUOX2 | Colon | 0.909091 | 0.833333 | 1 |
| CDH17 AND CDH3 | Colon | 1 | 1 | 1 |
| IFI6 AND TNFRSF11A | Colon | 1 | 1 | 1 |
| IFI6 AND GPR35 | Colon | 1 | 1 | 1 |
| IFI6 AND SI | Colon | 0.888889 | 1 | 0.8 |
| CXCL16 AND TM4SF5 | Esophagus | 0.782609 | 1 | 0.642857 |
| CXCL16 AND SYT13 | Esophagus | 0.727273 | 1 | 0.571429 |
| CXCL16 AND B3GNT3 | Esophagus | 0.727273 | 1 | 0.571429 |
| CXCL16 AND PTPRH | Esophagus | 0.6 | 0.5625 | 0.642857 |
| PTPRZ1 AND SPAM1 | Glioblastoma | 0.903226 | 1 | 0.823529 |
| GPM6B AND F2R | Glioblastoma | 0.866667 | 1 | 0.764706 |
| PTPRZ1 AND ADAM29 | Glioblastoma | 0.903226 | 1 | 0.823529 |
| PTPRZ1 AND STAB1 | Glioblastoma | 0.903226 | 1 | 0.823529 |
| PTPRZ1 AND F2R | Glioblastoma | 0.866667 | 1 | 0.764706 |
| NLGN4X AND LAPTM5 | Glioblastoma | 0.903226 | 1 | 0.823529 |
| PTPRZ1 AND ANTXR2 | Glioblastoma | 0.903226 | 1 | 0.823529 |
| PTPRZ1 AND LAPTM5 | Glioblastoma | 0.9375 | 1 | 0.882353 |
| NRCAM AND TGFBI | Glioblastoma | 0.83871 | 0.928571 | 0.764706 |
| PTPRZ1 AND CXCL16 | Glioblastoma | 0.866667 | 1 | 0.764706 |
| GPM6A AND F2R | Glioblastoma | 0.827586 | 1 | 0.705882 |
| GPM6A AND EMP3 | Glioblastoma | 0.827586 | 1 | 0.705882 |
| NRCAM AND F2R | Glioblastoma | 0.827586 | 1 | 0.705882 |
| PTPRZ1 AND BEST3 | Glioblastoma | 0.827586 | 1 | 0.705882 |
| NRCAM AND TNFRSF12A | Glioblastoma | 0.827586 | 1 | 0.705882 |
| PTPRZ1 AND TNFRSF12A | Glioblastoma | 0.827586 | 1 | 0.705882 |
| PTPRZ1 AND PIRT | Glioblastoma | 0.866667 | 1 | 0.764706 |
| PTPRZ1 AND IL17RA | Glioblastoma | 0.827586 | 1 | 0.705882 |
| MLC1 AND OR51B6 | Glioblastoma | 0.909091 | 0.9375 | 0.882353 |
| PTPRZ1 AND LYPD1 | Glioblastoma | 0.875 | 0.933333 | 0.823529 |
| NRCAM AND LAPTM5 | Glioblastoma | 0.9375 | 1 | 0.882353 |
| AQP4 AND SPAM1 | Glioblastoma | 0.827586 | 1 | 0.705882 |
| NLGN1 AND LAPTM5 | Glioblastoma | 0.827586 | 1 | 0.705882 |
| MLC1 AND FAM57A | Glioblastoma | 0.827586 | 1 | 0.705882 |
| MLC1 AND BMPR1A | Glioblastoma | 0.8125 | 0.866667 | 0.764706 |
| PTPRZ1 AND TGFBI | Glioblastoma | 0.827586 | 1 | 0.705882 |
| NRCAM AND HLA-DRB1 | Glioblastoma | 0.833333 | 0.789474 | 0.882353 |
| SYT11 AND ADAM12 | Glioblastoma | 0.823529 | 0.823529 | 0.823529 |
| MLC1 AND SLC2A10 | Glioblastoma | 0.866667 | 1 | 0.764706 |
| NRCAM AND CDH11 | Glioblastoma | 0.903226 | 1 | 0.823529 |
| PTPRZ1 AND HLA-DRB1 | Glioblastoma | 0.903226 | 1 | 0.823529 |
| PTPRZ1 AND CD93 | Glioblastoma | 0.827586 | 1 | 0.705882 |
| NRCAM AND CXCL16 | Glioblastoma | 0.903226 | 1 | 0.823529 |
| GPM6A AND CD93 | Glioblastoma | 0.8 | 0.923077 | 0.705882 |
| GPM6A AND ANTXR2 | Glioblastoma | 0.8 | 0.923077 | 0.705882 |
| SYT11 AND PCDH12 | Glioblastoma | 0.8 | 0.923077 | 0.705882 |
| AQP4 AND ADAM29 | Glioblastoma | 0.8 | 0.923077 | 0.705882 |
| MLC1 AND TNFRSF19 | Glioblastoma | 0.8 | 0.923077 | 0.705882 |
| GPR158 AND ABCA1 | Glioblastoma | 0.8 | 0.777778 | 0.823529 |
| PTPRZ1 AND LRIG3 | Glioblastoma | 0.827586 | 1 | 0.705882 |
| NRCAM AND CD93 | Glioblastoma | 0.827586 | 1 | 0.705882 |
| NRCAM AND BTN3A3 | Glioblastoma | 0.833333 | 0.789474 | 0.882353 |
| PTPRZ1 AND NKAIN4 | Glioblastoma | 0.8 | 0.923077 | 0.705882 |
| NRCAM AND VAMP8 | Glioblastoma | 0.882353 | 0.882353 | 0.882353 |
| PTPRZ1 AND SLC5A10 | Glioblastoma | 0.866667 | 1 | 0.764706 |
| GPM6B AND F2R | Glioma | 0.992701 | 1 | 0.985507 |
| GPM6A AND F2R | Glioma | 0.992701 | 1 | 0.985507 |
| PTPRZ1 AND F2R | Glioma | 0.985294 | 1 | 0.971014 |
| SYT11 AND HLA-B | Glioma | 0.956522 | 0.956522 | 0.956522 |
| SYT11 AND SLC40A1 | Glioma | 0.956522 | 0.956522 | 0.956522 |
| NRCAM AND F2R | Glioma | 0.938462 | 1 | 0.884058 |
| SYT11 AND TSPAN6 | Glioma | 0.970149 | 1 | 0.942029 |
| SYT11 AND ABCA1 | Glioma | 0.970588 | 0.985075 | 0.956522 |
| SYT11 AND PLGRKT | Glioma | 0.970149 | 1 | 0.942029 |
| SYT11 AND JAM2 | Glioma | 0.985294 | 1 | 0.971014 |
| PTPRZ1 AND LAPTM5 | Glioma | 0.985507 | 0.985507 | 0.985507 |
| SYT11 AND JTB | Glioma | 0.962406 | 1 | 0.927536 |
| SYT11 AND ATRAID | Glioma | 0.985294 | 1 | 0.971014 |
| SYT11 AND HLA-C | Glioma | 0.957143 | 0.943662 | 0.971014 |
| SYT11 AND HLA-G | Glioma | 0.964539 | 0.944444 | 0.985507 |
| PTPRZ1 AND SYT11 | Glioma | 0.985294 | 1 | 0.971014 |
| GPM6A AND BTN3A3 | Glioma | 0.970149 | 1 | 0.942029 |
| PTPRZ1 AND BTN3A3 | Glioma | 0.962406 | 1 | 0.927536 |

FIG. 8 (Cont.)

| Antigen Pair Logic | Cancer (short name) | F1 | Precision | Recall |
|---|---|---|---|---|
| KCNJ10 AND SLAMF7 | B-Cell Diffuse | 0.622222 | 0.528302 | 0.756757 |
| CD79B AND HTR1E | B-Cell Diffuse | 0.666667 | 0.807692 | 0.567568 |
| FCRL5 AND SLC22A14 | B-Cell Diffuse | 0.625 | 0.740741 | 0.540541 |
| CD72 AND FAT1 | B-Cell Diffuse | 0.619718 | 0.647059 | 0.594595 |
| P2RX5 AND CDH11 | B-Cell Diffuse | 0.637681 | 0.6875 | 0.594595 |
| P2RX5 AND KCNJ10 | B-Cell Diffuse | 0.666667 | 0.71875 | 0.621622 |
| FCRL5 AND KCNJ10 | B-Cell Diffuse | 0.709677 | 0.88 | 0.594595 |
| FCRL5 AND SLCO1B3 | B-Cell Diffuse | 0.619048 | 0.553191 | 0.702703 |
| FCRL5 AND GJD2 | B-Cell Diffuse | 0.62069 | 0.857143 | 0.486486 |
| FCRL5 AND GLRA2 | B-Cell Diffuse | 0.644068 | 0.863636 | 0.513514 |
| P2RX5 AND SLC22A2 | Mantle-Cell Lymphoma | 0.897436 | 0.875 | 0.921053 |
| P2RX5 AND HCN2 | Mantle-Cell Lymphoma | 0.911392 | 0.878049 | 0.947368 |
| P2RX5 AND ADCY10 | Mantle-Cell Lymphoma | 0.888889 | 0.837209 | 0.947368 |
| P2RX5 AND PVRL1 | Mantle-Cell Lymphoma | 0.891892 | 0.916667 | 0.868421 |
| P2RX5 AND NTSR2 | Mantle-Cell Lymphoma | 0.878049 | 0.818182 | 0.947368 |
| P2RX5 AND GHSR | Mantle-Cell Lymphoma | 0.906667 | 0.918919 | 0.894737 |
| P2RX5 AND SLC30A8 | Mantle-Cell Lymphoma | 0.911392 | 0.878049 | 0.947368 |
| P2RX5 AND PCDHGC4 | Mantle-Cell Lymphoma | 0.861111 | 0.911765 | 0.815789 |
| P2RX5 AND NKAIN4 | Mantle-Cell Lymphoma | 0.88 | 0.891892 | 0.868421 |
| P2RX5 AND CDH22 | Mantle-Cell Lymphoma | 0.9 | 0.857143 | 0.947368 |
| P2RX5 AND GRIN2B | Mantle-Cell Lymphoma | 0.853659 | 0.795455 | 0.921053 |
| P2RX5 AND MC2R | Mantle-Cell Lymphoma | 0.86747 | 0.8 | 0.947368 |
| P2RX5 AND CACNG1 | Mantle-Cell Lymphoma | 0.875 | 0.833333 | 0.921053 |
| P2RX5 AND ADAM7 | Mantle-Cell Lymphoma | 0.85 | 0.809524 | 0.894737 |
| CD79B AND HTR5A | Mantle-Cell Lymphoma | 0.848485 | 1 | 0.736842 |
| CD79B AND HCN2 | Mantle-Cell Lymphoma | 0.848485 | 1 | 0.736842 |
| P2RX5 AND GPR6 | Mantle-Cell Lymphoma | 0.876712 | 0.914286 | 0.842105 |
| P2RX5 AND CYP4A11 | Mantle-Cell Lymphoma | 0.842105 | 0.842105 | 0.842105 |
| P2RX5 AND GJD2 | Mantle-Cell Lymphoma | 0.933333 | 0.945946 | 0.921053 |
| P2RX5 AND HTR5A | Mantle-Cell Lymphoma | 0.897436 | 0.875 | 0.921053 |
| P2RX5 AND DISP2 | Mantle-Cell Lymphoma | 0.86747 | 0.8 | 0.947368 |
| CD79B AND ADCY10 | Mantle-Cell Lymphoma | 0.835821 | 0.965517 | 0.736842 |
| CD79B AND SLC30A8 | Mantle-Cell Lymphoma | 0.835821 | 0.965517 | 0.736842 |
| CD79B AND AMHR2 | Mantle-Cell Lymphoma | 0.835821 | 0.965517 | 0.736842 |
| CD79B AND EPHA8 | Mantle-Cell Lymphoma | 0.835821 | 0.965517 | 0.736842 |
| P2RX5 AND HTR1D | Mantle-Cell Lymphoma | 0.835443 | 0.804878 | 0.868421 |
| MS4A1 AND NTSR2 | Mantle-Cell Lymphoma | 0.835165 | 0.716981 | 1 |
| MS4A1 AND SLC22A9 | Mantle-Cell Lymphoma | 0.835165 | 0.716981 | 1 |
| P2RX5 AND AMHR2 | Mantle-Cell Lymphoma | 0.9 | 0.857143 | 0.947368 |
| P2RX5 AND PIRT | Mantle-Cell Lymphoma | 0.833333 | 0.882353 | 0.789474 |
| P2RX5 AND EPHA8 | Mantle-Cell Lymphoma | 0.923077 | 0.9 | 0.947368 |
| P2RX5 AND SLC22A14 | Mantle-Cell Lymphoma | 0.911392 | 0.878049 | 0.947368 |
| CD79B AND GJD2 | Mantle-Cell Lymphoma | 0.830769 | 1 | 0.710526 |
| CD79B AND GHSR | Mantle-Cell Lymphoma | 0.830769 | 1 | 0.710526 |
| CD79B AND FSHR | Mantle-Cell Lymphoma | 0.830769 | 1 | 0.710526 |
| P2RX5 AND CNTNAP4 | Mantle-Cell Lymphoma | 0.829268 | 0.772727 | 0.894737 |
| P2RX5 AND ROS1 | Mantle-Cell Lymphoma | 0.828571 | 0.90625 | 0.763158 |
| P2RX5 AND OR2L2 | Mantle-Cell Lymphoma | 0.853659 | 0.795455 | 0.921053 |
| P2RX5 AND GPR12 | Mantle-Cell Lymphoma | 0.876712 | 0.914286 | 0.842105 |
| P2RX5 AND JPH3 | Mantle-Cell Lymphoma | 0.827586 | 0.734694 | 0.947368 |
| MS4A1 AND HTR5A | Mantle-Cell Lymphoma | 0.826087 | 0.703704 | 1 |
| MS4A1 AND ADCY10 | Mantle-Cell Lymphoma | 0.826087 | 0.703704 | 1 |
| P2RX5 AND GABRB2 | Mantle-Cell Lymphoma | 0.825 | 0.785714 | 0.868421 |
| P2RX5 AND SCN1A | Mantle-Cell Lymphoma | 0.825 | 0.785714 | 0.868421 |
| P2RX5 AND SLC2A1 | Mantle-Cell Lymphoma | 0.846154 | 0.825 | 0.868421 |
| P2RX5 AND OR2C3 | Mantle-Cell Lymphoma | 0.829268 | 0.772727 | 0.894737 |
| CD79B AND OR10J1 | Mantle-Cell Lymphoma | 0.823529 | 0.933333 | 0.736842 |
| CD79B AND MC2R | Mantle-Cell Lymphoma | 0.823529 | 0.933333 | 0.736842 |
| CD79B AND CLDN20 | Mantle-Cell Lymphoma | 0.823529 | 0.933333 | 0.736842 |
| CD79B AND SLC22A14 | Mantle-Cell Lymphoma | 0.823529 | 0.933333 | 0.736842 |
| P2RX5 AND LCT | Mantle-Cell Lymphoma | 0.823529 | 0.744681 | 0.921053 |
| P2RX5 AND CHRNB2 | Mantle-Cell Lymphoma | 0.878049 | 0.818182 | 0.947368 |
| P2RX5 AND GPRC6A | Mantle-Cell Lymphoma | 0.820513 | 0.8 | 0.842105 |
| P2RX5 AND KCNA7 | Mantle-Cell Lymphoma | 0.857143 | 0.846154 | 0.868421 |
| P2RX5 AND GRM5 | Mantle-Cell Lymphoma | 0.842105 | 0.842105 | 0.842105 |
| P2RX5 AND OR10J1 | Mantle-Cell Lymphoma | 0.819277 | 0.755556 | 0.894737 |
| P2RX5 AND TRPM3 | Mantle-Cell Lymphoma | 0.819277 | 0.755556 | 0.894737 |
| P2RX5 AND CEACAM7 | Mantle-Cell Lymphoma | 0.819277 | 0.755556 | 0.894737 |
| P2RX5 AND SLC1A6 | Mantle-Cell Lymphoma | 0.819277 | 0.755556 | 0.894737 |
| P2RX5 AND LRFN2 | Mantle-Cell Lymphoma | 0.84507 | 0.909091 | 0.789474 |
| P2RX5 AND SLC22A9 | Mantle-Cell Lymphoma | 0.878049 | 0.818182 | 0.947368 |
| CD79B AND NKAIN4 | Mantle-Cell Lymphoma | 0.818182 | 0.964286 | 0.710526 |
| CD79B AND CDH22 | Mantle-Cell Lymphoma | 0.818182 | 0.964286 | 0.710526 |
| CD79B AND SLC1A6 | Mantle-Cell Lymphoma | 0.818182 | 0.964286 | 0.710526 |
| P2RX5 AND TMEM235 | Mantle-Cell Lymphoma | 0.818182 | 0.72 | 0.947368 |
| MS4A1 AND CLDN20 | Mantle-Cell Lymphoma | 0.817204 | 0.690909 | 1 |
| P2RX5 AND FSHR | Mantle-Cell Lymphoma | 0.906667 | 0.918919 | 0.894737 |

| Antigen Pair Logic | Cancer (short name) | F1 | Precision | Recall |
|---|---|---|---|---|
| DDR2 AND ATP8B2 | Leiomyosarcoma | 0.761905 | 1 | 0.615385 |
| FLT3 AND EMP3 | AML | 0.944559 | 0.974576 | 0.916335 |
| SLC22A16 AND HCST | AML | 0.939759 | 0.947368 | 0.932271 |
| SLC22A16 AND P2RX1 | AML | 0.937374 | 0.95082 | 0.924303 |
| SLC22A16 AND P2RY8 | AML | 0.928571 | 0.924901 | 0.932271 |
| CNTNAP1 AND CD163 | Liposarcoma | 0.8 | 0.823529 | 0.777778 |
| ADAM12 AND KCNU1 | Liposarcoma | 0.740741 | 0.666667 | 0.833333 |
| ADAM12 AND EMP3 | Liposarcoma | 0.727273 | 0.682927 | 0.777778 |
| ADAM12 AND SLC6A7 | Liposarcoma | 0.725 | 0.659091 | 0.805556 |
| ADAM12 AND MDGA2 | Liposarcoma | 0.75 | 0.681818 | 0.833333 |
| ADAM12 AND OR2C3 | Liposarcoma | 0.746988 | 0.659574 | 0.861111 |
| ADAM12 AND OR52D1 | Liposarcoma | 0.72093 | 0.62 | 0.861111 |
| ADAM12 AND CSMD2 | Liposarcoma | 0.746988 | 0.659574 | 0.861111 |
| ADAM12 AND SV2C | Liposarcoma | 0.738095 | 0.645833 | 0.861111 |
| ADAM12 AND HLA-DRB1 | Liposarcoma | 0.707317 | 0.630435 | 0.805556 |
| ADAM12 AND DRD1 | Liposarcoma | 0.765432 | 0.688889 | 0.861111 |
| ADAM12 AND LCT | Liposarcoma | 0.729412 | 0.632653 | 0.861111 |
| ADAM12 AND TRHR | Liposarcoma | 0.738095 | 0.645833 | 0.861111 |
| ADAM12 AND KCNV2 | Liposarcoma | 0.756098 | 0.673913 | 0.861111 |
| ADAM12 AND ADAM7 | Liposarcoma | 0.759494 | 0.697674 | 0.833333 |
| ADAM12 AND GABRA3 | Liposarcoma | 0.746988 | 0.659574 | 0.861111 |
| ADAM12 AND OR8B2 | Liposarcoma | 0.705882 | 0.612245 | 0.833333 |
| ADAM12 AND OR3A1 | Liposarcoma | 0.714286 | 0.625 | 0.833333 |
| ADAM12 AND GRIN2B | Liposarcoma | 0.698795 | 0.617021 | 0.805556 |
| ADAM12 AND GPR85 | Liposarcoma | 0.696629 | 0.584906 | 0.861111 |
| ADAM12 AND CACNG4 | Liposarcoma | 0.696629 | 0.584906 | 0.861111 |
| ADAM12 AND NMBR | Liposarcoma | 0.734177 | 0.674419 | 0.805556 |
| ADAM12 AND TRPM8 | Liposarcoma | 0.738095 | 0.645833 | 0.861111 |
| ADAM12 AND PCDHA9 | Liposarcoma | 0.738095 | 0.645833 | 0.861111 |
| ADAM12 AND GLRA3 | Liposarcoma | 0.717949 | 0.666667 | 0.777778 |
| ADAM12 AND GRM4 | Liposarcoma | 0.691358 | 0.622222 | 0.777778 |
| ADAM12 AND GYPC | Liposarcoma | 0.688889 | 0.574074 | 0.861111 |
| ADAM12 AND LRRTM4 | Liposarcoma | 0.684211 | 0.65 | 0.722222 |
| ADAM12 AND FCAMR | Liposarcoma | 0.756098 | 0.673913 | 0.861111 |
| ADAM12 AND P2RY4 | Liposarcoma | 0.681818 | 0.576923 | 0.833333 |
| ADAM12 AND MLANA | Liposarcoma | 0.722892 | 0.638298 | 0.833333 |
| ADAM12 AND SLCO6A1 | Liposarcoma | 0.729412 | 0.632653 | 0.861111 |
| ADAM12 AND ACSL6 | Liposarcoma | 0.674699 | 0.595745 | 0.777778 |
| ADAM12 AND ATP8B2 | Liposarcoma | 0.722222 | 0.722222 | 0.722222 |
| ADAM12 AND GPR83 | Liposarcoma | 0.740741 | 0.666667 | 0.833333 |
| TTYH3 AND LRP1 | Liposarcoma | 0.686567 | 0.741935 | 0.638889 |
| GJC1 AND LAPTM5 | Liposarcoma | 0.666667 | 0.6 | 0.75 |
| ADAM12 AND GABRG2 | Liposarcoma | 0.659341 | 0.545455 | 0.833333 |
| ADAM12 AND BEST3 | Liposarcoma | 0.753247 | 0.707317 | 0.805556 |
| ADAM12 AND ADAM21 | Liposarcoma | 0.658537 | 0.586957 | 0.75 |
| ADAM12 AND CD74 | Liposarcoma | 0.658537 | 0.586957 | 0.75 |
| TTYH3 AND PKD2 | Liposarcoma | 0.657143 | 0.676471 | 0.638889 |
| CNTNAP1 AND LAPTM5 | Liposarcoma | 0.777778 | 0.777778 | 0.777778 |
| TTYH3 AND COLEC12 | Liposarcoma | 0.647887 | 0.657143 | 0.638889 |
| TTYH3 AND PDGFRB | Liposarcoma | 0.647059 | 0.6875 | 0.611111 |
| ADAM12 AND CATSPERD | Liposarcoma | 0.64 | 0.615385 | 0.666667 |
| TTYH3 AND DCHS1 | Liposarcoma | 0.638889 | 0.638889 | 0.638889 |
| TTYH3 AND FAT4 | Liposarcoma | 0.637681 | 0.666667 | 0.611111 |
| CD163 AND PCDH7 | Liposarcoma | 0.658228 | 0.604651 | 0.722222 |
| ADAM12 AND LAPTM5 | Liposarcoma | 0.634146 | 0.565217 | 0.722222 |
| EMP3 AND SLC2A10 | Liposarcoma | 0.75 | 0.75 | 0.75 |
| GPR34 AND SLC6A7 | Liposarcoma | 0.630137 | 0.621622 | 0.638889 |
| TTYH3 AND PCDH12 | Liposarcoma | 0.630137 | 0.621622 | 0.638889 |
| TTYH3 AND MMP14 | Liposarcoma | 0.647887 | 0.657143 | 0.638889 |
| ADAM12 AND MUC12 | Liposarcoma | 0.717949 | 0.666667 | 0.777778 |
| TTYH3 AND SGCD | Liposarcoma | 0.625 | 0.714286 | 0.555556 |
| ADAM12 AND GPR22 | Liposarcoma | 0.623656 | 0.508772 | 0.805556 |
| ATP8B2 AND SLC2A10 | Liposarcoma | 0.717949 | 0.666667 | 0.777778 |
| TTYH3 AND PLXDC1 | Liposarcoma | 0.622951 | 0.76 | 0.527778 |
| TTYH3 AND EMP1 | Liposarcoma | 0.621622 | 0.605263 | 0.638889 |
| TTYH3 AND CNTNAP1 | Liposarcoma | 0.621622 | 0.605263 | 0.638889 |
| TTYH3 AND VASN | Liposarcoma | 0.621622 | 0.605263 | 0.638889 |
| ADAM12 AND SLC17A1 | Liposarcoma | 0.621622 | 0.605263 | 0.638889 |
| TTYH3 AND PLXNA1 | Liposarcoma | 0.621622 | 0.605263 | 0.638889 |
| TTYH3 AND SLC2A10 | Liposarcoma | 0.619718 | 0.628571 | 0.611111 |
| OLR1 AND SLC50A1 | Lung Adenocarcinoma | 0.655172 | 0.826087 | 0.542857 |
| OSMR AND SLC50A1 | Lung Adenocarcinoma | 0.625 | 0.833333 | 0.5 |
| BST2 AND TLCD1 | Lung Adenocarcinoma | 0.619469 | 0.813953 | 0.5 |
| PON2 AND CD44 | Lung Adenocarcinoma | 0.62069 | 0.782609 | 0.514286 |
| PON2 AND IFNAR2 | Lung Adenocarcinoma | 0.641509 | 0.944444 | 0.485714 |
| SLC50A1 AND FZD6 | Lung Adenocarcinoma | 0.62069 | 0.782609 | 0.514286 |
| KCNJ10 AND CD53 | B-Cell Diffuse | 0.759494 | 0.714286 | 0.810811 |

FIG. 8 (Cont.)

| Antigen Pair Logic | Cancer (short name) | F1 | Precision | Recall |
|---|---|---|---|---|
| CD79B AND GPR6 | Mantle-Cell Lymphoma | 0.8125 | 1 | 0.684211 |
| CD79B AND ADAM7 | Mantle-Cell Lymphoma | 0.8125 | 1 | 0.684211 |
| CD79B AND LRFN2 | Mantle-Cell Lymphoma | 0.8125 | 1 | 0.684211 |
| CD79B AND SLCO1A2 | Mantle-Cell Lymphoma | 0.8125 | 1 | 0.684211 |
| CD79B AND GPR12 | Mantle-Cell Lymphoma | 0.8125 | 1 | 0.684211 |
| CD79B AND CLDN15 | Mantle-Cell Lymphoma | 0.811594 | 0.903226 | 0.736842 |
| CD79B AND GPR50 | Mantle-Cell Lymphoma | 0.811594 | 0.903226 | 0.736842 |
| CD79B AND HRH3 | Mantle-Cell Lymphoma | 0.811594 | 0.903226 | 0.736842 |
| EDNRB AND GPR19 | Melanoma | 0.9 | 1 | 0.818182 |
| EDNRB AND LRIG3 | Melanoma | 0.9 | 1 | 0.818182 |
| EDNRB AND ZACN | Melanoma | 0.9 | 1 | 0.818182 |
| EDNRB AND FAT1 | Melanoma | 0.9 | 1 | 0.818182 |
| EDNRB AND EFNB2 | Melanoma | 0.9 | 1 | 0.818182 |
| EDNRB AND GHR | Melanoma | 0.9 | 1 | 0.818182 |
| EDNRB AND SLC22A18 | Melanoma | 0.9 | 1 | 0.818182 |
| NKAIN1 AND CBX3 | Neuroblastoma | 0.866242 | 0.931507 | 0.809524 |
| NKAIN1 AND ALK | Neuroblastoma | 0.867925 | 0.92 | 0.821429 |
| GPR19 AND PTK7 | Neuroblastoma | 0.854054 | 0.782178 | 0.940476 |
| GPR19 AND GPNMB | Neuroblastoma | 0.842105 | 0.827586 | 0.857143 |
| ALK AND CD163 | Neuroblastoma | 0.840764 | 0.90411 | 0.785714 |
| KCNQ2 AND CBX3 | Neuroblastoma | 0.839506 | 0.871795 | 0.809524 |
| CACNA1B AND CD276 | Neuroblastoma | 0.836957 | 0.77 | 0.916667 |
| SYT11 AND ALK | Neuroblastoma | 0.840764 | 0.90411 | 0.785714 |
| SLC1A2 AND EGFR | Oligodendroglioma | 0.933333 | 0.933333 | 0.933333 |
| CSPG5 AND EGFR | Oligodendroglioma | 0.888889 | 1 | 0.8 |
| OMG AND EGFR | Oligodendroglioma | 0.857143 | 0.923077 | 0.8 |
| KCNJ10 AND EGFR | Oligodendroglioma | 0.933333 | 0.933333 | 0.933333 |
| MLC1 AND EGFR | Oligodendroglioma | 0.896552 | 0.928571 | 0.866667 |
| DTNA AND EGFR | Oligodendroglioma | 0.888889 | 1 | 0.8 |
| ASTN1 AND EGFR | Oligodendroglioma | 0.888889 | 1 | 0.8 |
| CDH10 AND EGFR | Oligodendroglioma | 0.857143 | 0.923077 | 0.8 |
| GPR19 AND EGFR | Oligodendroglioma | 0.903226 | 0.875 | 0.933333 |
| UNC5A AND EGFR | Oligodendroglioma | 0.846154 | 1 | 0.733333 |
| GPR158 AND EGFR | Oligodendroglioma | 0.8 | 0.8 | 0.8 |
| OPCML AND EGFR | Oligodendroglioma | 0.8 | 0.8 | 0.8 |
| SEZ6 AND EGFR | Oligodendroglioma | 0.928571 | 1 | 0.866667 |
| FXYD6 AND EGFR | Oligodendroglioma | 0.928571 | 1 | 0.866667 |
| CSPG5 AND EDNRB | Oligodendroglioma | 0.8 | 0.8 | 0.8 |
| ASTN1 AND CSPG4 | Oligodendroglioma | 0.8 | 0.7 | 0.933333 |
| BEST3 AND BMPR1B | Oligodendroglioma | 0.866667 | 0.866667 | 0.866667 |
| CSPG5 AND MUC13 | Oligodendroglioma | 0.888889 | 1 | 0.8 |
| BEST3 AND SLC7A5 | Oligodendroglioma | 0.777778 | 0.666667 | 0.933333 |
| MLC1 AND CD38 | Oligodendroglioma | 0.774194 | 0.75 | 0.8 |
| KCNC1 AND EGFR | Oligodendroglioma | 0.774194 | 0.75 | 0.8 |
| CSPG5 AND FOLR1 | Oligodendroglioma | 0.774194 | 0.75 | 0.8 |
| MLC1 AND MUC1 | Oligodendroglioma | 0.785714 | 0.846154 | 0.733333 |
| CSPG5 AND CLDN18 | Oligodendroglioma | 0.827586 | 0.857143 | 0.8 |
| CSPG5 AND VTCN1 | Oligodendroglioma | 0.846154 | 1 | 0.733333 |
| LRRTM4 AND EGFR | Oligodendroglioma | 0.764706 | 0.684211 | 0.866667 |
| GABBR2 AND EGFR | Oligodendroglioma | 0.764706 | 0.684211 | 0.866667 |
| CSPG5 AND MUC1 | Oligodendroglioma | 0.764706 | 0.684211 | 0.866667 |
| DTNA AND MUC13 | Oligodendroglioma | 0.764706 | 0.684211 | 0.866667 |
| BEST3 AND SLC39A6 | Oligodendroglioma | 0.823529 | 0.736842 | 0.933333 |
| MLC1 AND VTCN1 | Oligodendroglioma | 0.8 | 1 | 0.666667 |
| SLC1A2 AND VTCN1 | Oligodendroglioma | 0.814815 | 0.916667 | 0.733333 |
| SLC1A2 AND PTK7 | Oligodendroglioma | 0.8 | 1 | 0.666667 |
| CSPG5 AND GUCY2C | Oligodendroglioma | 0.758621 | 0.785714 | 0.733333 |
| DTNA AND MUC1 | Oligodendroglioma | 0.769231 | 0.909091 | 0.666667 |
| KCNJ10 AND CD276 | Oligodendroglioma | 0.8125 | 0.764706 | 0.866667 |
| SLCO1C1 AND EGFR | Oligodendroglioma | 0.827586 | 0.857143 | 0.8 |
| CSPG5 AND CA9 | Oligodendroglioma | 0.756757 | 0.636364 | 0.933333 |
| MUC16 AND SYT11 | Ovarian | 0.736842 | 1 | 0.583333 |
| EPHA10 AND VTCN1 | Ovarian | 0.666667 | 1 | 0.5 |
| MUC16 AND CSPG5 | Ovarian | 0.666667 | 1 | 0.5 |
| MUC16 AND PPAPDC1A | Ovarian | 0.666667 | 0.777778 | 0.583333 |
| MUC16 AND LAMP5 | Ovarian | 0.631579 | 0.857143 | 0.5 |
| MUC16 AND GPRC6A | Ovarian | 0.631579 | 0.857143 | 0.5 |
| MUC16 AND KCNU1 | Ovarian | 0.608696 | 0.636364 | 0.583333 |
| TRPM8 AND EPCAM | Prostate | 0.857143 | 1 | 0.75 |
| STEAP2 AND SLC43A1 | Prostate | 1 | 1 | 1 |

| Antigen Pair Logic | Cancer (short name) | F1 | Precision | Recall |
|---|---|---|---|---|
| PTPRCAP AND KCNJ10 | B-Cell Diffuse | 0.722222 | 0.742857 | 0.702703 |
| CD48 AND KCNJ10 | B-Cell Diffuse | 0.724638 | 0.78125 | 0.675676 |
| IL2RB AND FAT1 | Anaplastic Lymphoma | 0.64 | 0.8 | 0.533333 |
| CXCL9 AND GPR19 | T-Cell, Peripheral | 0.75 | 0.75 | 0.75 |
| CXCL9 AND KCNJ10 | T-Cell, Peripheral | 0.769231 | 0.833333 | 0.714286 |
| CXCL9 AND SEMA4D | T-Cell, Peripheral | 0.784314 | 0.869565 | 0.714286 |
| CXCL9 AND TTYH2 | T-Cell, Peripheral | 0.714286 | 0.714286 | 0.714286 |
| CXCL9 AND SLC38A1 | T-Cell, Peripheral | 0.652174 | 0.833333 | 0.535714 |
| BCAP31 AND TTYH2 | Melanoma | 0.952381 | 1 | 0.909091 |
| GPR137B AND KCNN2 | Melanoma | 0.9 | 1 | 0.818182 |
| PLP2 AND SLC6A15 | Melanoma | 0.9 | 1 | 0.818182 |
| BCAP31 AND EMP3 | Melanoma | 0.952381 | 1 | 0.909091 |
| TNFSF9 AND GPR137B | Melanoma | 0.952381 | 1 | 0.909091 |
| C11orf24 AND GPR137B | Melanoma | 0.9 | 1 | 0.818182 |
| NKAIN4 AND PTPRZ1 | Oligodendroglioma | 0.888889 | 1 | 0.8 |
| KCNK15 AND CSPG5 | Ovarian | 0.8 | 1 | 0.666667 |
| KCNK15 AND EPHA10 | Ovarian | 0.785714 | 0.6875 | 0.916667 |
| KCNK15 AND SLC2A1 | Ovarian | 0.758621 | 0.647059 | 0.916667 |
| KCNK15 AND NMUR2 | Ovarian | 0.75 | 0.75 | 0.75 |
| ADAM12 AND EMP3 | Sarcoma | 1 | 1 | 1 |
| CD99 AND PCDHA9 | Sarcoma | 0.740741 | 1 | 0.588235 |
| ADAM12 AND SLC6A7 | Sarcoma | 0.8125 | 0.866667 | 0.764706 |
| ADAM12 AND KCNU1 | Sarcoma | 0.75 | 0.652174 | 0.882353 |
| CDH17 AND FXYD5 | Stomach | 0.911111 | 0.87234 | 0.953488 |
| CDH17 AND CDH3 | Stomach | 0.8 | 0.765957 | 0.837209 |
| CDH17 AND TACSTD2 | Stomach | 0.911392 | 1 | 0.837209 |
| CDH17 AND EDNRA | Stomach | 0.876404 | 0.847826 | 0.906977 |
| CDH17 AND PDPN | Stomach | 0.83871 | 0.78 | 0.906977 |
| CDH17 AND MCAM | Stomach | 0.727273 | 0.597015 | 0.930233 |
| CDH17 AND CDH5 | Stomach | 0.829787 | 0.764706 | 0.906977 |
| CDH17 AND IFITM2 | Stomach | 0.824742 | 0.740741 | 0.930233 |
| VSIG1 AND TNFRSF12A | Stomach | 0.714286 | 0.925926 | 0.581395 |
| VSIG1 AND VANGL1 | Stomach | 0.714286 | 0.925926 | 0.581395 |
| CDH17 AND APOLD1 | Stomach | 0.780952 | 0.66129 | 0.953488 |
| VSIG1 AND FAT1 | Stomach | 0.705882 | 0.96 | 0.55814 |
| VSIG1 AND PROCR | Stomach | 0.704225 | 0.892857 | 0.581395 |
| CDH17 AND OSMR | Stomach | 0.866667 | 0.829787 | 0.906977 |
| CDH17 AND C5AR1 | Stomach | 0.822222 | 0.787234 | 0.860465 |
| VSIG1 AND CDH11 | Stomach | 0.695652 | 0.923077 | 0.55814 |
| CDH17 AND PDGFRB | Stomach | 0.853933 | 0.826087 | 0.883721 |
| CDH17 AND LDLRAD3 | Stomach | 0.690265 | 0.557143 | 0.906977 |
| VSIG1 AND EFNB2 | Stomach | 0.684932 | 0.833333 | 0.581395 |
| CDH17 AND ANO1 | Stomach | 0.894118 | 0.904762 | 0.883721 |
| CDH17 AND GJA4 | Stomach | 0.716981 | 0.603175 | 0.883721 |
| CDH17 AND CALCRL | Stomach | 0.823529 | 0.833333 | 0.813953 |
| CDH17 AND PODXL | Stomach | 0.847059 | 0.857143 | 0.837209 |
| CDH17 AND SLC2A3 | Stomach | 0.690909 | 0.567164 | 0.883721 |
| VSIG1 AND EPHA2 | Stomach | 0.676923 | 1 | 0.511628 |
| CDH17 AND FCGR3B | Stomach | 0.771084 | 0.8 | 0.744186 |
| CDH17 AND CD81 | Stomach | 0.718447 | 0.616667 | 0.860465 |
| VSIG1 AND LRIG3 | Stomach | 0.675676 | 0.806452 | 0.581395 |
| CDH17 AND CXCL9 | Stomach | 0.707317 | 0.74359 | 0.674419 |
| CDH17 AND SLC41A1 | Stomach | 0.727273 | 0.597015 | 0.930233 |
| TSPAN8 AND BST2 | Stomach | 0.724638 | 0.961538 | 0.581395 |
| ATP8B1 AND FXYD5 | Stomach | 0.91358 | 0.973684 | 0.860465 |
| VSIG1 AND F2R | Stomach | 0.714286 | 0.925926 | 0.581395 |
| VSIG1 AND CDH17 | Stomach | 0.735294 | 1 | 0.581395 |
| CDH17 AND ABCC1 | Stomach | 0.880952 | 0.902439 | 0.860465 |
| CDH17 AND PLXDC1 | Stomach | 0.813187 | 0.770833 | 0.860465 |
| CDH17 AND SLC29A1 | Stomach | 0.772277 | 0.672414 | 0.906977 |
| CDH17 AND RHBDF2 | Stomach | 0.752688 | 0.7 | 0.813953 |
| VSIG1 AND TTYH3 | Stomach | 0.666667 | 0.827586 | 0.55814 |
| VSIG1 AND SLC1A5 | Stomach | 0.675676 | 0.806452 | 0.581395 |
| CDH17 AND DIO2 | Stomach | 0.66 | 0.578947 | 0.767442 |
| CDH17 AND F2RL2 | Stomach | 0.9 | 0.972973 | 0.837209 |
| MUC17 AND CDH3 | Stomach | 0.788732 | 1 | 0.651163 |
| ATP8B1 AND CXCR4 | Stomach | 0.826667 | 0.96875 | 0.72093 |
| VSIG1 AND CD82 | Stomach | 0.657895 | 0.757576 | 0.581395 |
| VSIG1 AND BST2 | Stomach | 0.675676 | 0.806452 | 0.581395 |

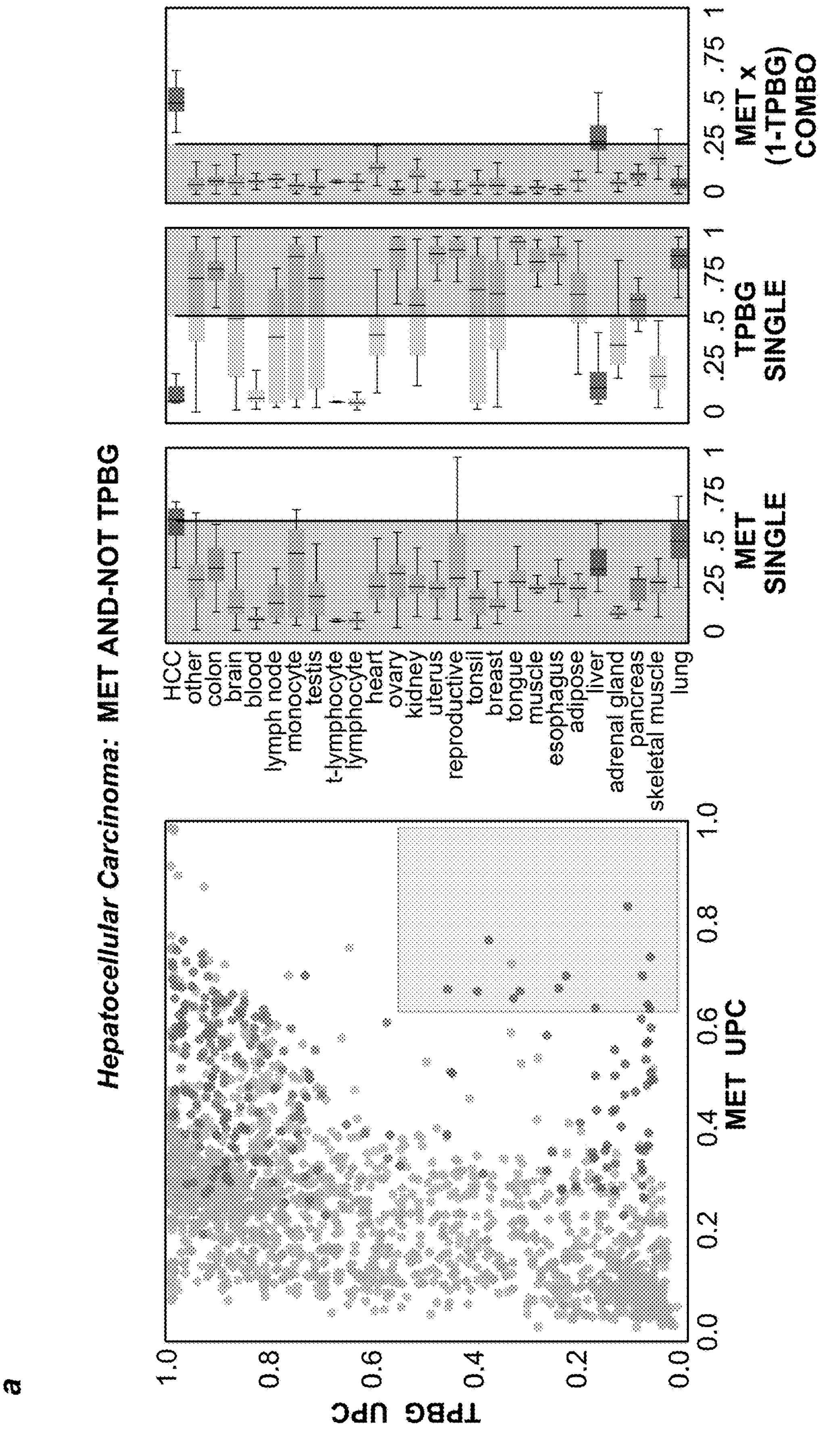
FIG. 12 (Cont. 1)

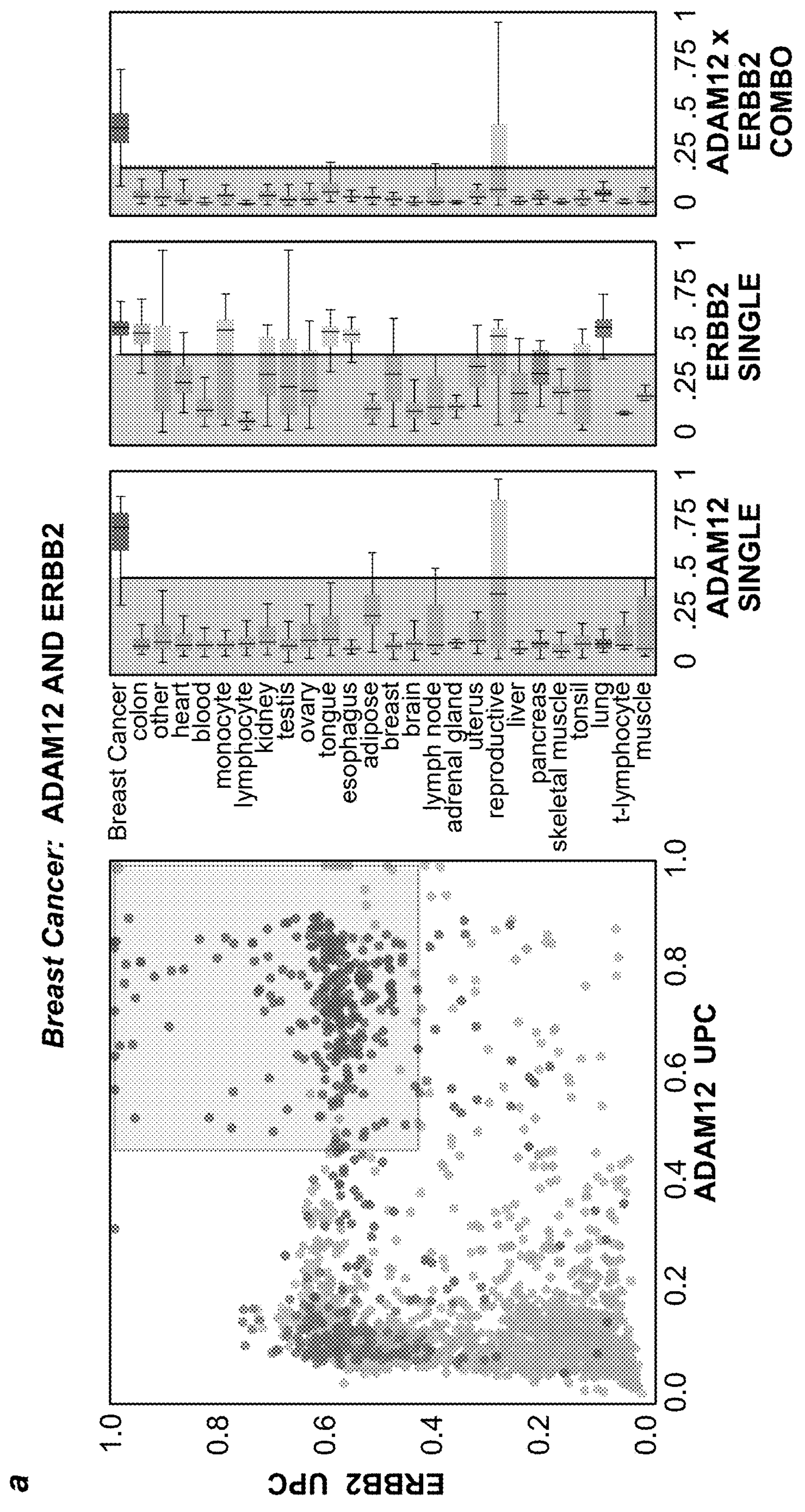
FIG. 12 (Cont. 2)

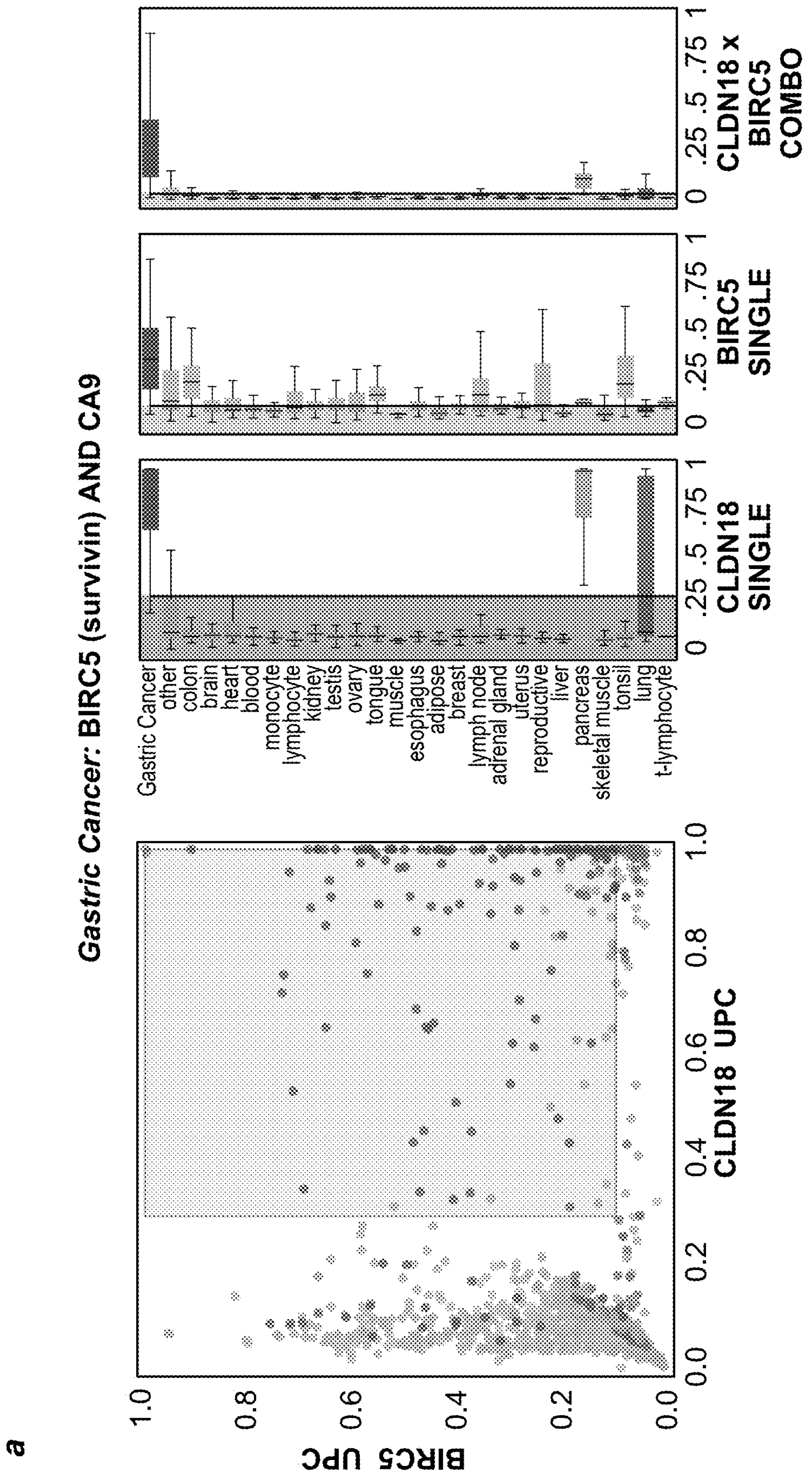
FIG. 12 (Cont. 3)

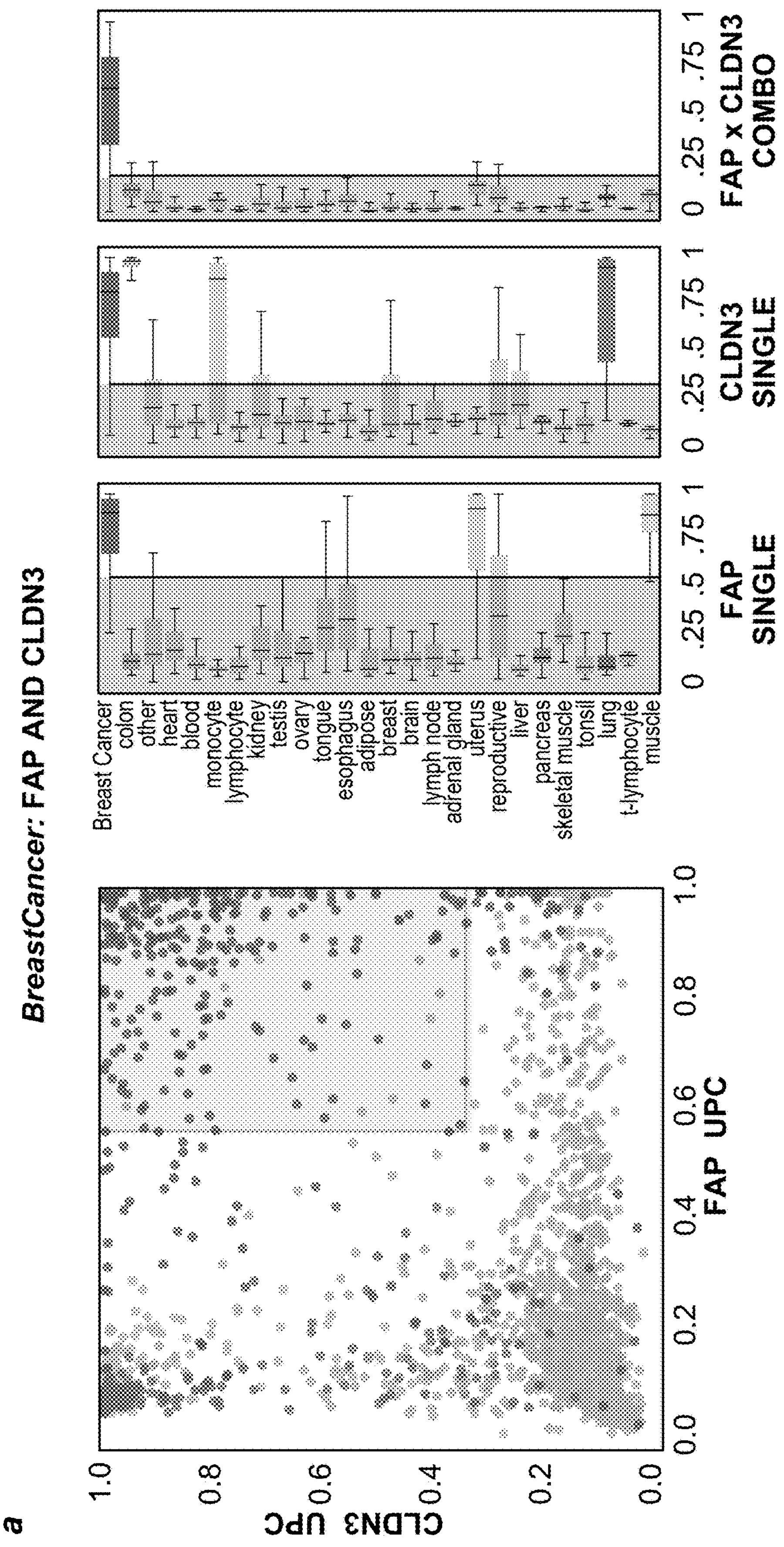
FIG. 12 (Cont. 4)

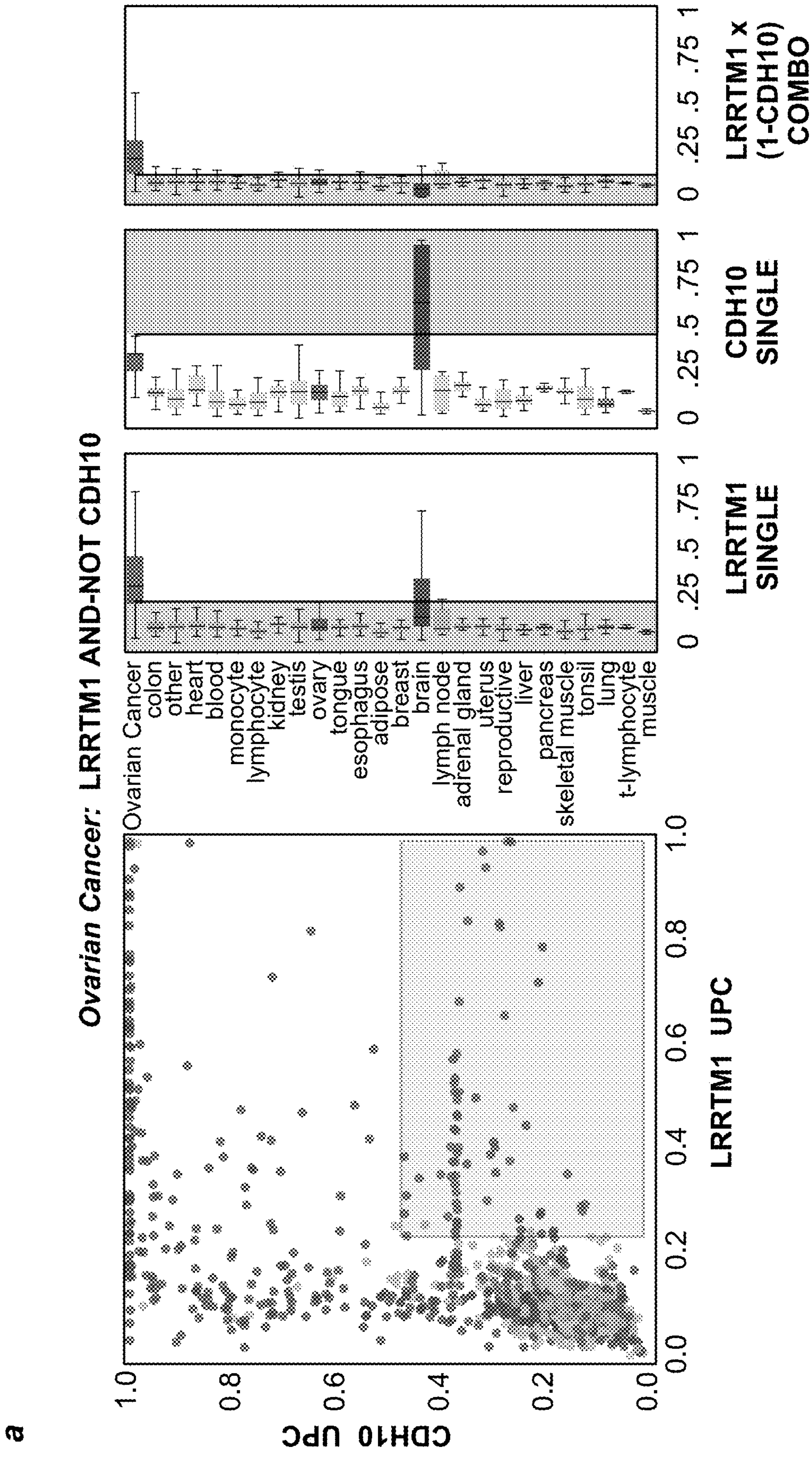
FIG. 12 (Cont. 5)

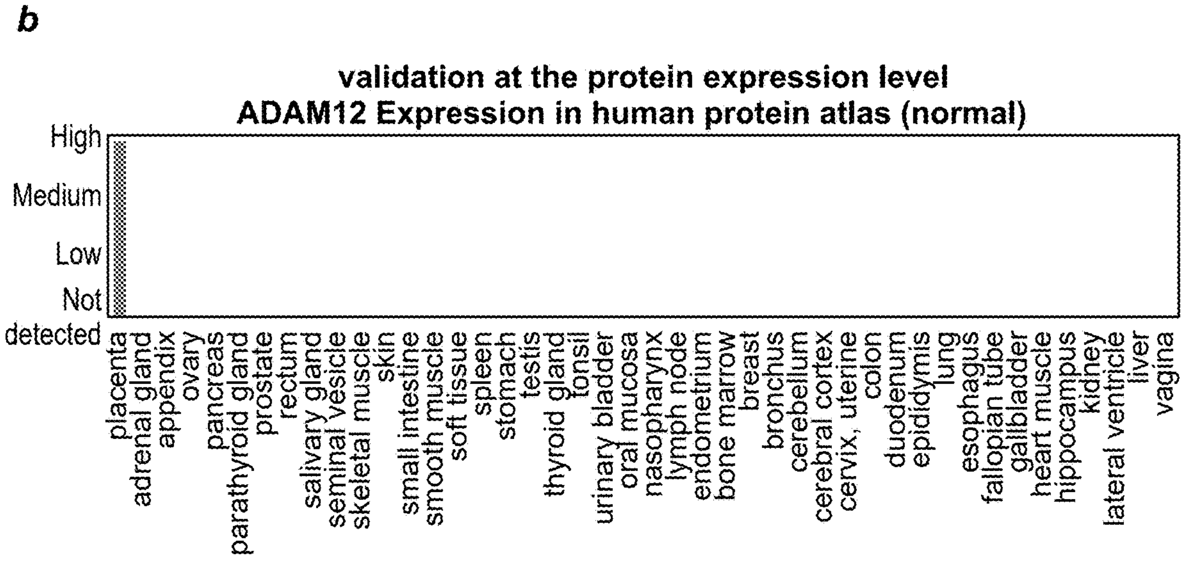
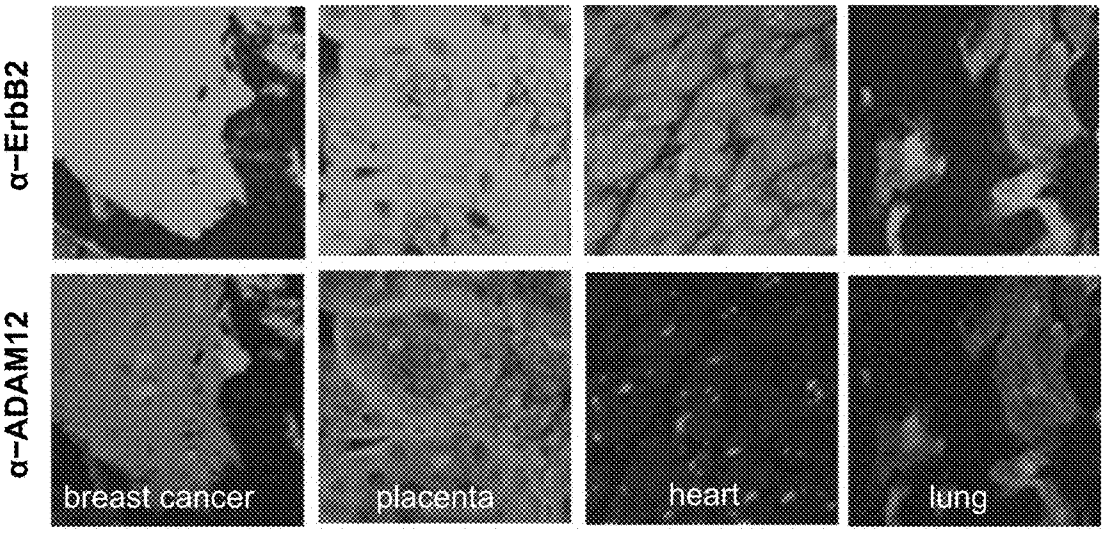
FIG. 12 (Cont. 6)

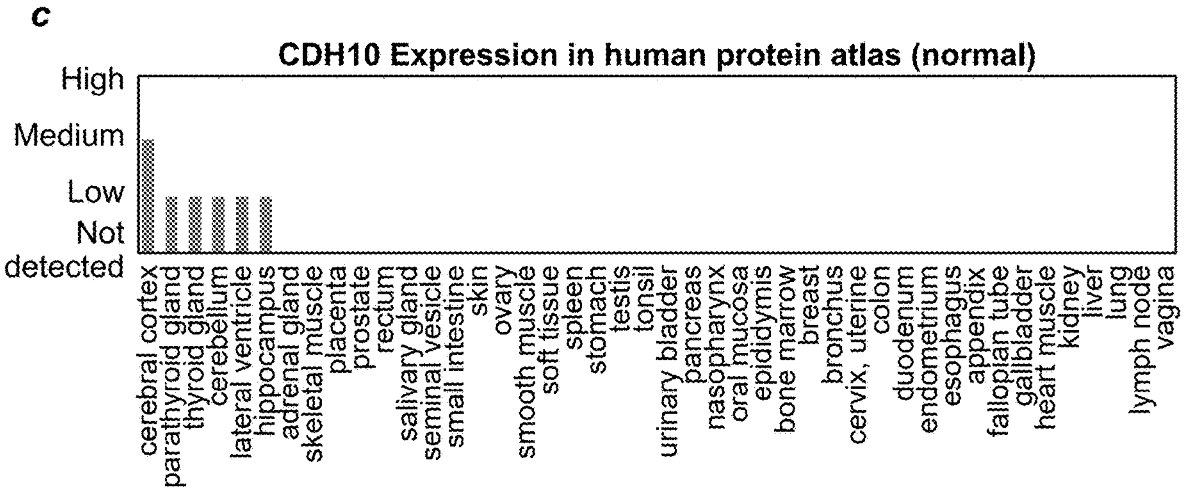
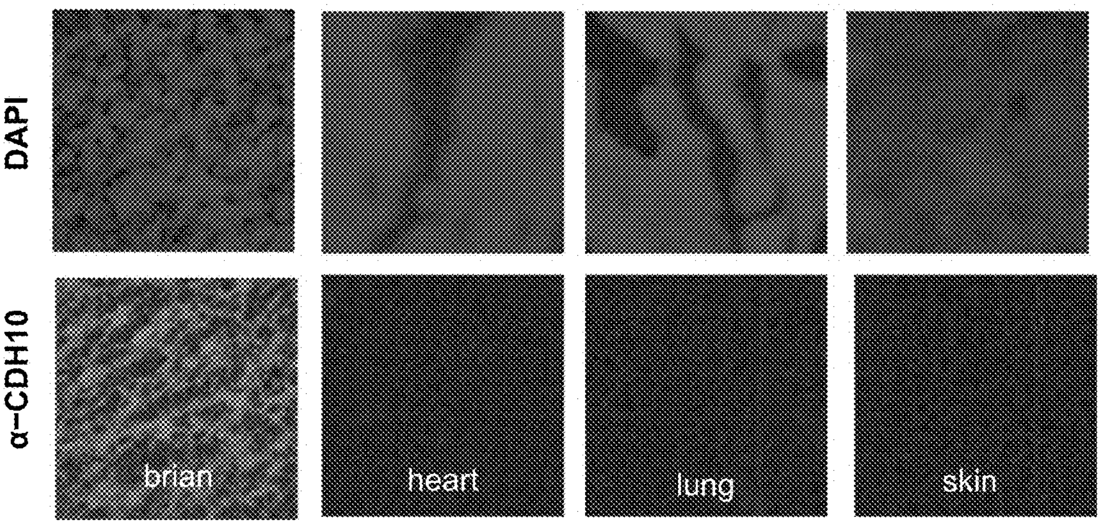
FIG. 12 (Cont. 7)

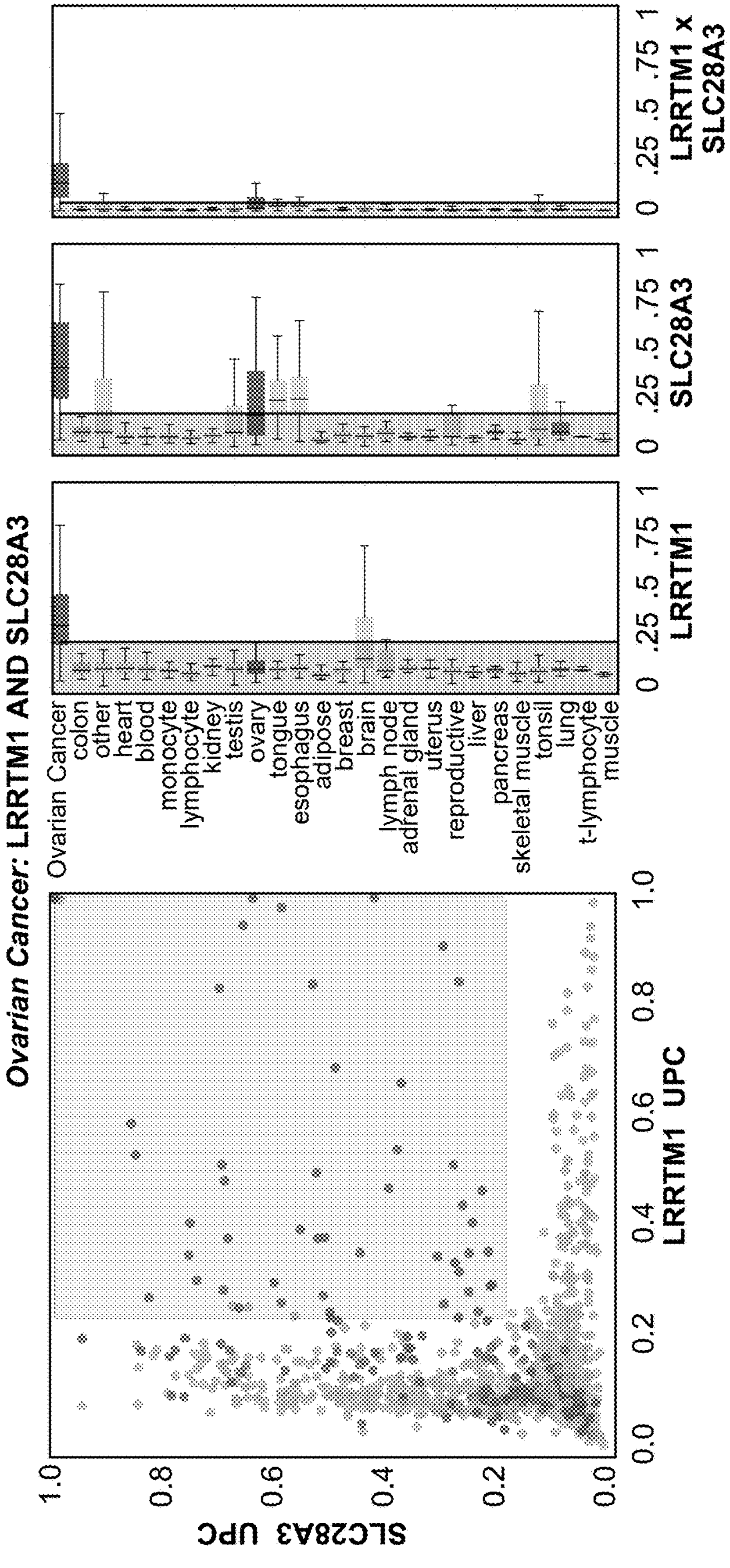
FIG. 13 (Cont. 1)

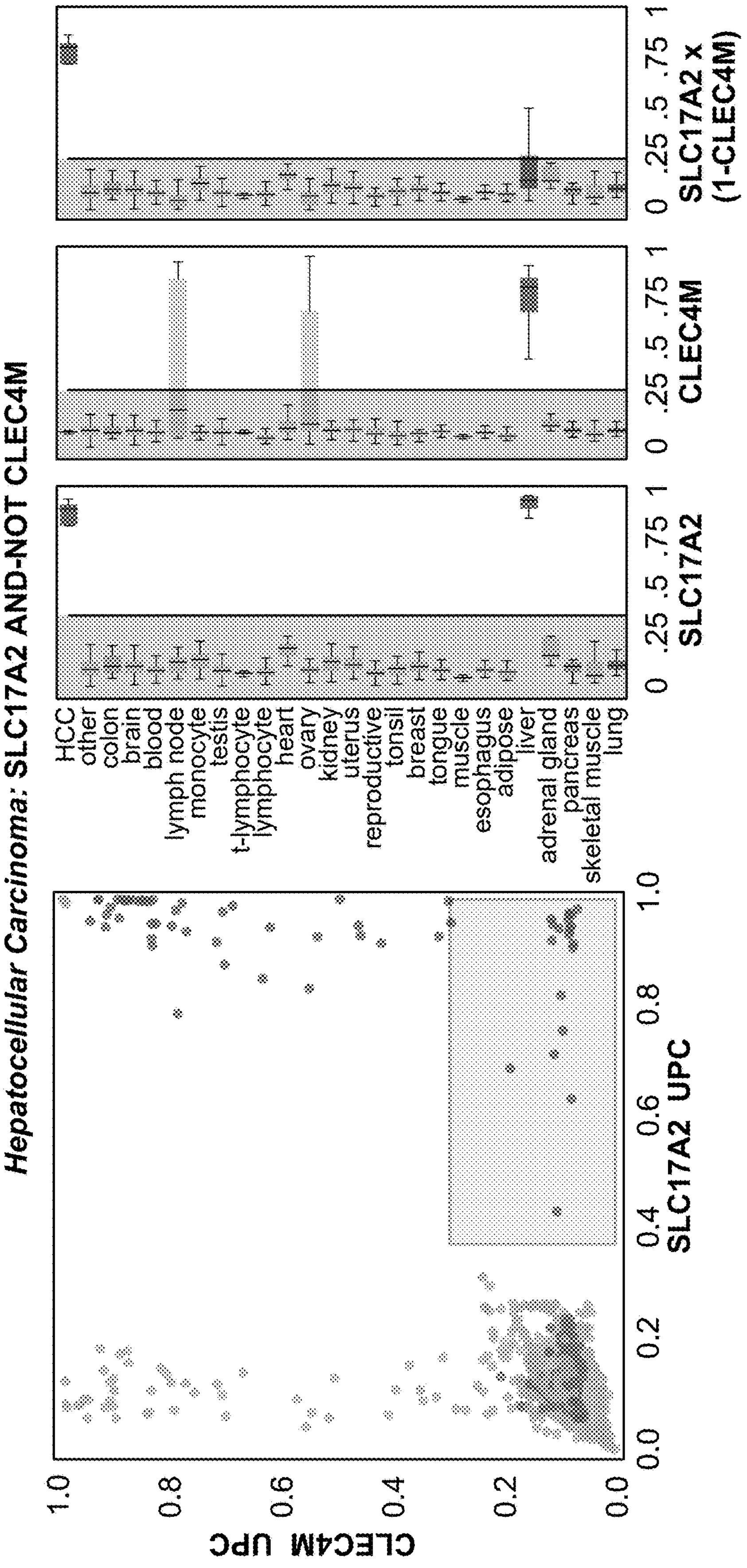
FIG. 13 (Cont. 2)

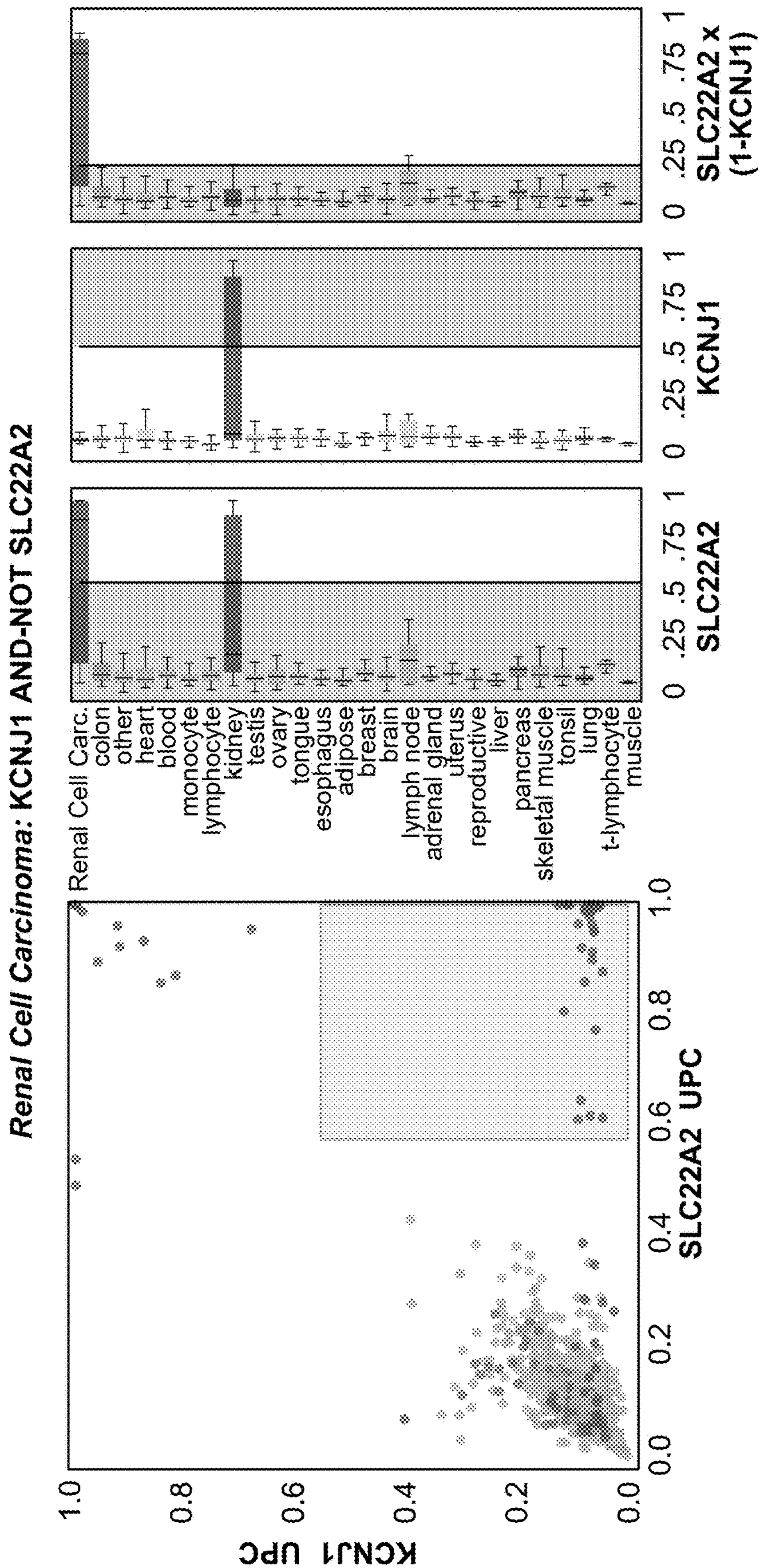
FIG. 13 (Cont. 3)

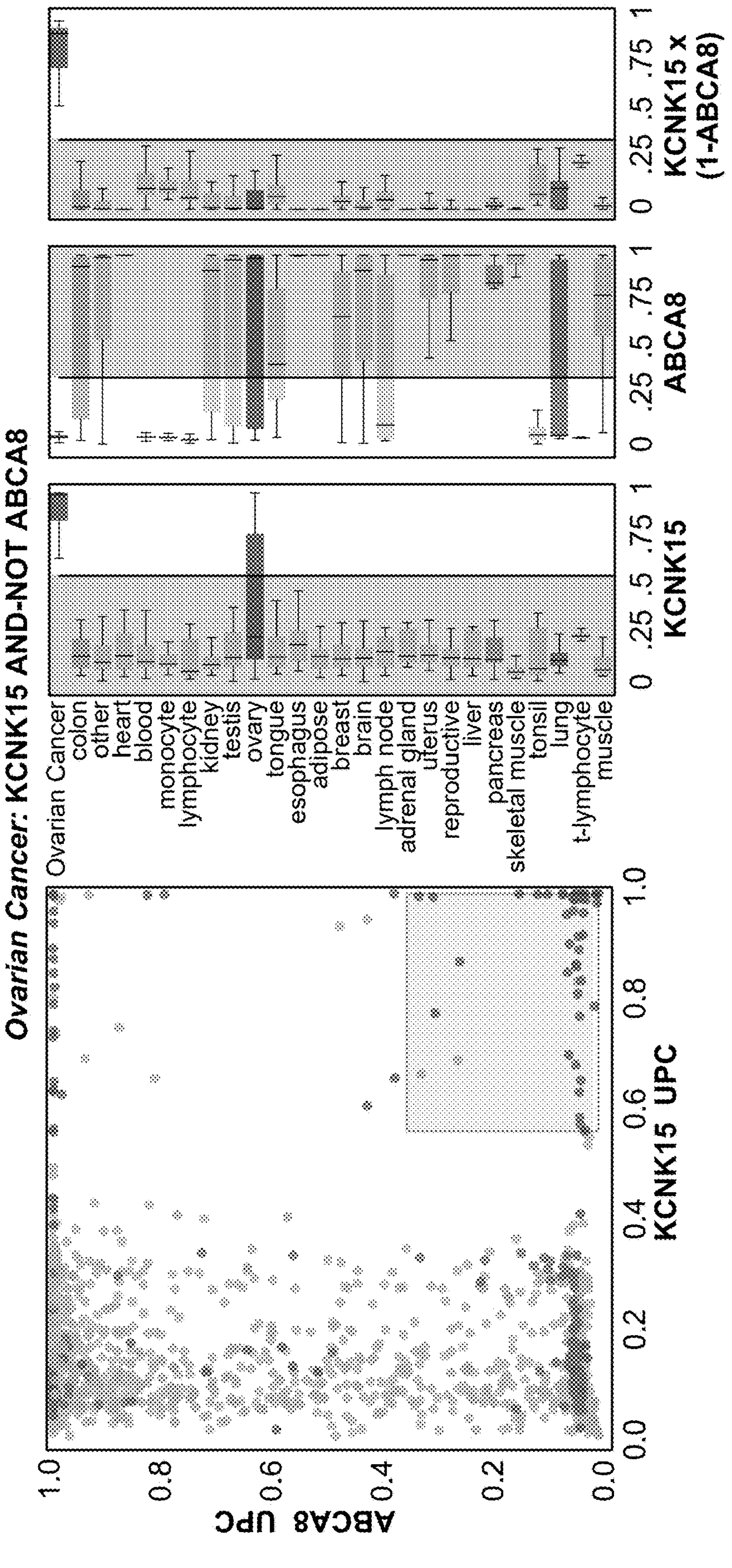
FIG. 13 (Cont. 4)

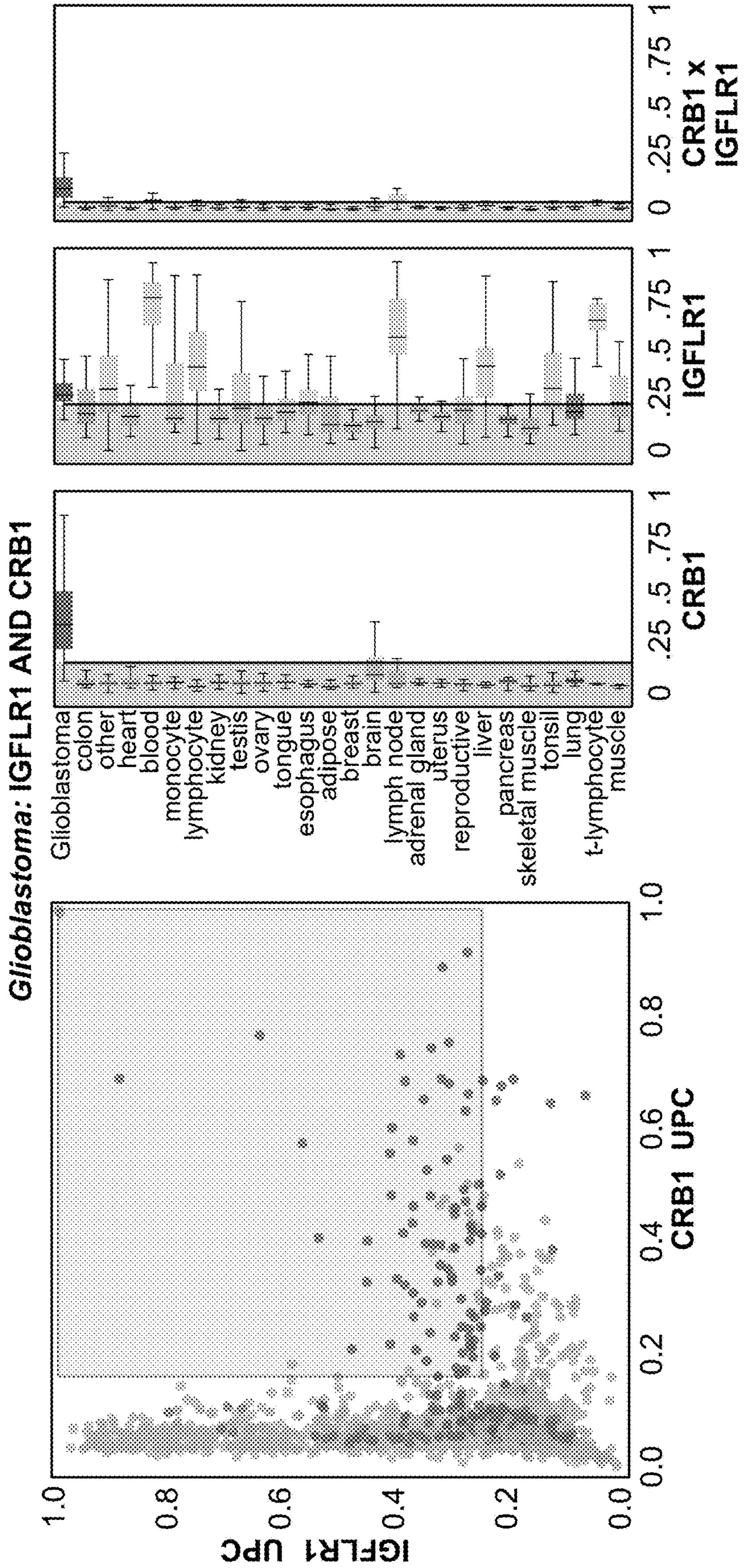
FIG. 13 (Cont. 5)

FIG. 16

| | |
|---|---|
| Breast Cancer | HER2[42]<br>EpCAM[40]<br>Meosthelin[44]<br>MET[39] |
| Colon Cancer | EGFR[38]<br>NKG2D[46] |
| Gastric Cancer | CLDN18[37] |
| Glioblastoma | GD2[36]<br>EGFR[35]<br>EPHA2[34]<br>IL13RA2[33]<br>HER2[43] |
| Hepatocellular Carcinoma | EpCAM[32]<br>GPC3[31] |
| Melanoma | GD2[30]<br>MAGE[29]<br>MET[28]<br>MART1[27]<br>GP100[26] |
| Neuroblastoma | GD2[24]<br>L1CAM/CD171[25] |

| | | |
|---|---|---|
| Non Small Cell Lung Cancer | EGFR[23]<br>GPC3[41] | |
| Ovarian Cancer | FOLR1[21] | |
| Pancreatic Ductal Carcinoma | CLDN18[20]<br>PSCA[19]<br>Mesothelin[45] | |
| Prostate Cancer | PSMA[18] | |
| Renal Cell Carcinoma | AXL[17]<br>CAIX-2[16]<br>ROR2[15] | |
| Soft Tissue Sarcoma | GD2[14]<br>HER2[47] | |
| Solid Tumors (Basket Trials) | CD70[1]<br>CEA[2]<br>NY-ESO-1[3]<br>EGFR[22]<br>EPCAM[4]<br>HER2[5]<br>GPC3[6] | NKG2D[8]<br>Mesothelin[9]<br>MUC1[10]<br>CD133[11]<br>ROR1[12]<br>VEGFR[13] |

1 NCT02830724
2 NCT02850536, NCT02349724
3 NCT03240861, NCT02869217, NCT02588612, and others
4 NCT03013712
5 NCT00924287
6 NCT02932956
7 NCT03415100,
8 NCT03018405, NCT03018405
9 NCT02580747, NCT02930993, NCT01583686, and others
10 NCT02617134, NCT02587689, NCT03179007, NCT02839954
11 NCT02541370
12 NCT02706392
13 NCT01218867
14 NCT01953900
15 NCT03393936
16 Lamers, C.H.J., et al
Treatment of metastatic renal cell carcinoma (mRCC) with CAIX CAR-engineered T-cells-a completed study overview
(2016). Biochem. Soc. Trans. 44, 951-959.
17 NCT03393936
18 NCT01140373, NCT03089203
19 NCT02744287
20 NCT03159819
21 Kershaw, M.H., et al. (2006).
A Phase I Study on Adoptive Immunotherapy Using Gene-Modified T Cells for Ovarian Cancer.
Am. Assoc. Cancer Res. 12, 6106-6115.
22 NCT02873390, NCT03182816, NCT02862028
23 Feng, K., et al. (2016).
Chimeric antigen receptor-modified T cells for the immunotherapy of patients with EGFR-expressing advanced relapsed/refractory non-small cell lung cancer.
Sci. China Life Sci. 59, 468–479.
24 NCT02919046, NCT02765243, NCT01953900, and others
25 NCT02311621
26 NCT00509496, NCT00203879.
27 NCT00706992, NCT00512889, NCT00720031, and others
28 NCT03060356
29 NCT01273181, NCT01694472, NCT02153905
30 NCT02919046
31 NCT02723942, NCT02905188, NCT02395250, and others
32 NCT02729493
33 NCT02208362
34 NCT02575261
35 NCT03152435
36 NCT03252171
37 NCT03159819
38 NCT03152435
39 NCT01837602, NCT03060356
40 NCT02915445
41 NCT02876978
42 NCT02547961, NCT02713984
43 NCT01109095, NCT02442297, NCT01087294, and others
44 NCT02792114
45 NCT01897415, NCT02159716, NCT02465983, and others
46 NCT03310008

FIG. 17

| Antigen Pair Logic | andnot | f1_min | f05_min | P_train | R_train | P_test | R_test | gid |
|---|---|---|---|---|---|---|---|---|
| (DLL3 AND EGFR) | AND | 0.69230769 | 0.66176471 | 0.828125 | 0.71621622 | 0.64285714 | 0.75 | 1956010683 |
| (DLL3 AND ERBB2) | AND | 0.46808511 | 0.47413793 | 0.74545455 | 0.55405405 | 0.47826087 | 0.45833333 | 2064010683 |
| (DLL3 AND NOT-GRM3) | NOT | 0.56 | 0.546875 | 0.75362319 | 0.7027027 | 0.53846154 | 0.58333333 | 2913010683 |
| (DLL3 AND MUC1) | AND | 0.58823529 | 0.56818182 | 0.73239437 | 0.7027027 | 0.55555556 | 0.625 | 4582010683 |
| (NRCAM AND DLL3) | AND | 0.79166667 | 0.79166667 | 0.83823529 | 0.77027027 | 0.79166667 | 0.79166667 | 4897010683 |
| (DLL3 AND NOT-ROR1) | NOT | 0.72483221 | 0.72192513 | 0.72 | 0.72972973 | 0.72 | 0.75 | 4919010683 |
| (EGFR AND NOT-ERBB2) | NOT | 0.62857143 | 0.80882353 | 0.93333333 | 0.56756757 | 1 | 0.45833333 | 1956002064 |
| (EGFR AND GRM3) | AND | 0.62857143 | 0.69536424 | 0.73684211 | 0.56756757 | 1 | 0.45833333 | 1956002913 |
| (EGFR AND IL13RA2) | AND | 0.60431655 | 0.62874251 | 0.64615385 | 0.56756757 | 1 | 0.45833333 | 1956003598 |
| (EGFR AND NOT-MUC1) | NOT | 0.62857143 | 0.80882353 | 0.95454545 | 0.56756757 | 1 | 0.45833333 | 1956004582 |
| (EGFR AND NOT-ROR1) | NOT | 0.62857143 | 0.80882353 | 0.95348837 | 0.55405405 | 1 | 0.45833333 | 1956004919 |
| (GRM3 AND ERBB2) | AND | 0.4 | 0.31716418 | 0.32432432 | 0.81081081 | 0.27868852 | 0.70833333 | 2064002913 |
| (BCAN AND ERBB2) | NOT | 0.80851064 | 0.83333333 | 0.85074627 | 0.77027027 | 0.91304348 | 0.875 | 2064063827 |
| (GRM3 AND IL13RA2) | AND | 0.52238806 | 0.55732484 | 0.58333333 | 0.47297297 | 1 | 0.375 | 2913003598 |
| (GRM3 AND MUC1) | AND | 0.52941176 | 0.43835616 | 0.3902439 | 0.86486486 | 0.40909091 | 0.75 | 2913004582 |
| (NRCAM AND NOT-GRM3) | NOT | 0.76923077 | 0.84285714 | 0.85507246 | 0.7972973 | 1 | 0.625 | 2913004897 |
| (GRM3 AND ROR1) | AND | 0.36538462 | 0.27616279 | 0.31279621 | 0.89189189 | 0.2375 | 0.79166667 | 2913004919 |
| (BCAN AND NOT-GRM3) | NOT | 0.84444444 | 0.87962963 | 0.98245614 | 0.75675676 | 0.9047619 | 0.79166667 | 2913063827 |
| (IL13RA2 AND MUC1) | AND | 0.47368421 | 0.50546448 | 0.50684932 | 0.5 | 0.64285714 | 0.375 | 3598004582 |
| (IL13RA2 AND ROR1) | AND | 0.46357616 | 0.45811518 | 0.45454545 | 0.47297297 | 0.88888889 | 0.33333333 | 3598004919 |
| (BCAN AND NRCAM) | AND | 0.78082192 | 0.78729282 | 0.79166667 | 0.77027027 | 0.91304348 | 0.875 | 4897063827 |
| (BCAN AND PTPRZ1) | AND | 0.78082192 | 0.78729282 | 0.79166667 | 0.77027027 | 0.91304348 | 0.875 | 5803063827 |

SYSTEMS AND METHODS FOR TARGETING CANCER CELLS

CROSS-REFERENCE

This application is a § 371 national phase of International Application No. PCT/US2019/060357, filed on Nov. 7, 2019, which claims the benefit of U.S. provisional application Ser. No. 62/757,595, filed on Nov. 8, 2018, which applications are incorporated herein in their entireties for all purposes.

GOVERNMENT RIGHTS

This invention was made with government support under grant nos. GM071966, GM071508, HL117798 and CA196277 awarded by the National Institutes of Health. The government has certain rights in the invention.

INCORPORATION BY REFERENCE OF SEQUENCE LISTING PROVIDED AS A TEXT FILE

A Sequence Listing is provided herewith as a text file, "UCSF-569WO_SF2019-080-2_SeqList_ST25" created on Nov. 7, 2019 and having a size of 2,553 KB. The contents of the text file are incorporated by reference herein in their entirety.

INTRODUCTION

Immune cell activation can be engineered ex vivo through expression of various designer antigen-triggered immune cell receptors including, e.g., synthetic chimeric antigen receptors (CAR), binding-triggered transcriptional switches such as synthetic Notch polypeptides (synNotch), inhibitory CARs (iCARs), split CARs, and engineered T cell Receptors (TCR). In addition, engineered multi-specific immune activating molecules that are specific for a combination of antigens are also used to specifically target an immune response to particular cancer cells having particular antigen expression. A goal of such immune cell activation is targeting and killing of cancer cells in a patient, while avoiding or at least minimizing or reducing immune activation in response to non-cancerous cells that results in the killing of non-cancerous cells.

SUMMARY

The present disclosure provides immune cells genetically modified to produce two antigen-triggered polypeptides, each recognizing a different cell surface antigen, wherein the two different cell surface antigens employed are selected from those pairs described herein. The present disclosure further provides systems comprising two antigen-triggered polypeptides (or nucleic acids encoding same), each recognizing a different cell surface antigen, wherein the two different cell surface antigens employed are selected from those pairs described herein. Also provided are method of killing a target cancer cell, using the described genetically modified immune cells and/or systems. The present disclosure also provides polyspecific-immune inducing polypeptides including first and second antigen binding domains specific for first and second antigens, respectively, present on the surface of a target cancer cell.

BRIEF DESCRIPTION OF THE DRAWINGS

FIG. 1 provides antigen combinations for various cancers.

FIG. 2 provides amino acid sequences of antigens within antigen combinations.

FIG. 6 provides antigen pairs useful in polyspecific-immune-inducing polypeptides described herein.

FIG. 7 provides clinical antigen AND-gate combinations for various exemplary cancers useful in polyspecific-immune-inducing polypeptides described herein.

FIG. 8 provides antigen AND-gate combinations for various exemplary cancers useful in polyspecific-immune-inducing polypeptides described herein.

FIG. 17 provides certain antigen combinations for targeting glioblastoma target cells.

DEFINITIONS

Figure 3A:
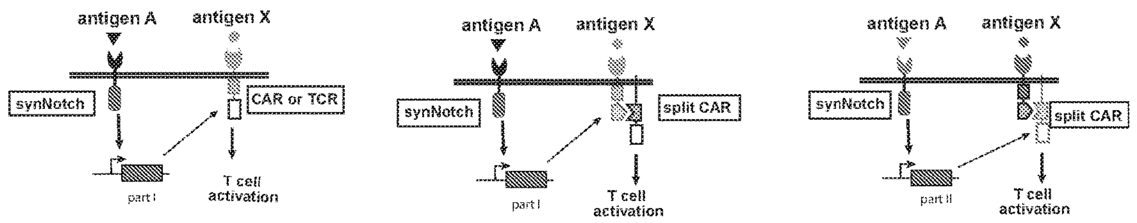
FIG. 3A-3B provide schematic depictions of various antigen-triggered polypeptides; and AND and AND-NOT logic gates using the antigen-triggered polypeptides.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. *Sci Transl Med* (2013); 5(215):215ra172; Glienke et al. *Front Pharmacol* (2015) 6:21; Kakarla & Gottschalk 52 *Cancer J*(2014) 20(2):151-5; Riddell et al. *Cancer J* (2014) 20(2):141-4; Pegram et al. *Cancer J* (2014) 20(2):127-33; Cheadle et al. *Immunol Rev* (2014) 257(1):91-106; Barrett et al. *Annu Rev Med* (2014) 65:333-47; Sadelain et al. *Cancer Discov* (2013) 3(4):388-98; Cartellieri et al., *J Biomed Biotechnol* (2010) 956304; the disclosures of which are incorporated herein by reference in their entirety.

As used herein, the term "immune cells" generally includes white blood cells (leukocytes) which are derived from hematopoietic stem cells (HSC) produced in the bone marrow. "Immune cells" includes, e.g., lymphocytes (T cells, B cells, natural killer (NK) cells) and myeloid-derived cells (neutrophil, eosinophil, basophil, monocyte, macrophage, dendritic cells).

"T cell" includes all types of immune cells expressing CD3 including T-helper cells (CD4+ cells), cytotoxic T-cells (CD8+ cells), T-regulatory cells (Treg) and gamma-delta T cells.

A "cytotoxic cell" includes $CD8^+$ T cells, natural-killer (NK) cells, and neutrophils, which cells are capable of mediating cytotoxicity responses.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a mammal, e.g., in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (e.g., rats, mice), lagomorphs (e.g., rabbits), non-human primates, humans, canines, felines, ungulates (e.g., equines, bovines, ovines, porcines, caprines), etc. In some cases, the individual is a human.

A "therapeutically effective amount" or "efficacious amount" refers to the amount of an agent, or combined amounts of two agents, that, when administered to a mammal or other subject for treating a disease, is sufficient to effect such treatment for the disease. The "therapeutically effective amount" will vary depending on the agent(s), the disease and its severity and the age, weight, etc., of the subject to be treated.

By "specifically binds" or "selectively bind" is meant that the molecule binds preferentially to the target of interest or binds with greater affinity to the target than to other molecules. For example, a DNA molecule will bind to a substantially complementary sequence and not to unrelated sequences. Specific binding may refer to non-covalent or covalent preferential binding to a molecule relative to other molecules or moieties in a solution or reaction mixture (e.g., an antibody specifically binds to a particular polypeptide or epitope relative to other available polypeptides). In some embodiments, the affinity of one molecule for another molecule to which it specifically binds is characterized by a $K_D$ (dissociation constant) of $10^{-5}$ M or less (e.g., $10^{-6}$ M or less, $10^{-7}$ M or less, 108 M or less, $10^{-9}$ M or less, $10^{-10}$ M or less, $10^{-11}$ M or less, $10^{-12}$ M or less, $10^{-13}$ M or less, $10^{-14}$ M or less, $10^{-15}$ M or less, or $10^{-16}$ M or less). "Affinity" refers to the strength of binding, increased binding affinity being correlated with a lower $K_D$.

The terms "antibody" and "immunoglobulin", as used herein, are used interchangeably may generally refer to whole or intact molecules or fragments thereof and modified and/or conjugated antibodies or fragments thereof that have been modified and/or conjugated. The immunoglobulins can be divided into five different classes, based on differences in the amino acid sequences in the constant region of the heavy chains. All immunoglobulins within a given class will have very similar heavy chain constant regions. These differences can be detected by sequence studies or more commonly by serological means (i.e. by the use of antibodies directed to these differences). Immunoglobulin classes include IgG (Gamma heavy chains), IgM (Mu heavy chains), IgA (Alpha heavy chains), IgD (Delta heavy chains), and IgE (Epsilon heavy chains).

Antibody or immunoglobulin may refer to a class of structurally related glycoproteins consisting of two pairs of polypeptide chains, one pair of light (L) low molecular weight chains and one pair of heavy (H) chains, all four inter-connected by disulfide bonds. The structure of immunoglobulins has been well characterized, see for instance *Fundamental Immunology* Ch. 7 (Paul, W., ed., 2nd ed. Raven Press, N.Y. (1989)). Briefly, each heavy chain typically is comprised of a heavy chain variable region (abbreviated as $V_H$) and a heavy chain constant region (abbreviated as $C_H$). The heavy chain constant region typically is comprised of three domains, $C_H1$, $C_H2$, and $C_H3$. Each light chain typically is comprised of a light chain variable region (abbreviated as $V_L$) and a light chain constant region (abbreviated herein as $C_L$). The light chain constant region typically is comprised of one domain, $C_L$. The $V_H$ and $V_L$ regions may be further subdivided into regions of hypervariability (or hypervariable regions which may be hypervariable in sequence and/or form of structurally defined loops), also termed complementarity determining regions (CDRs), interspersed with regions that are more conserved, termed framework regions (FRs).

Whole or largely intact antibodies are generally multivalent, meaning they may simultaneously bind more than one molecule of antigen whereas antibody fragments may be monovalent. Antibodies produced by an organism as part of an immune response are generally monospecific, meaning they generally bind a single species of antigen. Multivalent monospecific antibodies, i.e. antibodies that bind more than one molecule of a single species of antigen, may bind a single antigen epitope (e.g., a monoclonal antibody) or multiple different antigen epitopes (e.g., a polyclonal antibody).

Multispecific (e.g., bispecific) antibodies, which bind multiple species of antigen, may be readily engineered by those of ordinary skill in the art and, thus, may be encompassed within the use of the term "antibody" used herein where appropriate. Also, multivalent antibody fragments may be engineered, e.g., by the linking of two monovalent antibody fragments. As such, bivalent and/or multivalent antibody fragments may be encompassed within the use of the term "antibody", where appropriate, as the ordinary skilled artisan will be readily aware of antibody fragments, e.g., those described below, which may be linked in any convenient and appropriate combination to generate multivalent monospecific or polyspecific (e.g., bispecific) antibody fragments.

Antibody fragments include but are not limited to antigen-binding fragments (Fab or F(ab), including Fab' or F(ab'), $(Fab)_2$, $F(ab')_2$, etc.), single chain variable fragments (scFv or Fv), "third generation" (3G) molecules, etc. which are capable of binding the epitopic determinant. These antibody fragments retain some ability to selectively bind to the subject antigen, examples of which include, but are not limited to:

(1) Fab, the fragment which contains a monovalent antigen-binding fragment of an antibody molecule can be produced by digestion of whole antibody with the enzyme papain to yield an intact light chain and a portion of one heavy chain;

(2) Fab', the fragment of an antibody molecule can be obtained by treating whole antibody with pepsin, followed by reduction, to yield an intact light chain and a portion of the heavy chain; two Fab' fragments are obtained per antibody molecule;

(3) $(Fab)_2$, the fragment of the antibody that can be obtained by treating whole antibody with the enzyme pepsin without subsequent reduction;

(4) $F(ab)_2$ is a dimer of two Fab' fragments held together by two disulfide bonds;

(5) Fv, defined as a genetically engineered fragment containing the variable region of the light chain and the variable region of the heavy chain expressed as two chains;

(6) Single chain antibody ("SCA"), defined as a genetically engineered molecule containing the variable region of the light chain, the variable region of the heavy chain, linked by a suitable polypeptide linker as a genetically fused single chain molecule; such single chain antibodies may be in the form of multimers such as diabodies, triabodies, tetrabodies, etc. which may or may not be polyspecific (see, for example, WO 94/07921 and WO 98/44001) and (7) "3G", including single domain (typically a variable heavy domain devoid of a light chain) and "miniaturized" antibody molecules (typically a full-sized Ab or mAb in which non-essential domains have been removed).

A "biological sample" encompasses a variety of sample types obtained from an individual and can be used in a diagnostic or monitoring assay. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents, solubilization, or enrichment for certain components, such as polynucleotides or polypeptides. The term "biological sample" encompasses a clinical sample, and also includes cells in culture, cell supernatants, cell lysates, serum, plasma, biological fluid, and tissue samples. The term "biological sample" includes urine, saliva, cerebrospinal fluid, interstitial fluid, ocular fluid, synovial fluid, blood fractions such as plasma and serum, and the like. The term "biological sample" also includes solid tissue samples, tissue culture samples, and cellular samples.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a target antigen" includes a plurality of such antigens and reference to "the system" includes reference to one or more systems and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides an immune cell genetically modified to produce two antigen-triggered polypeptides, each recognizing a different cell surface antigen, wherein the two different cell surface antigens employed are selected from those pairs described herein. The present disclosure provides a system of two antigen-triggered polypeptides, each recognizing a different cell surface antigen, wherein the two different cell surface antigens employed are selected from those pairs described herein. The present disclosure provides a method of killing a target cancer cell, using a genetically modified immune cell or a system of the present disclosure. Also provided are polyspecific-immune-inducing polypeptides (PIIP) having a first antigen binding domain specific for a first antigen present on the surface of a target cancer cell and a second antigen binding domain specific for a second antigen present on the surface of the target cancer cell.

The present disclosure provides an in vitro or ex vivo genetically modified cytotoxic immune cell, where the cytotoxic immune cell is genetically modified to produce two different antigen-triggered polypeptides that recognize two different cell surface antigens, and where at least one of the two different cell surface antigens is present on the surface of a target cancer cell. In some cases, the two different antigen-triggered polypeptides comprise: a) a first antigen-triggered polypeptide that binds specifically to a first target cell surface antigen present on a target cancer cell; and b) a second antigen-triggered polypeptide that binds specifically to a second target cell surface antigen. In some cases, the genetically modified cytotoxic immune cell is a genetically modified cytotoxic T cell or a genetically modified natural killer cell. In some cases, the two different antigen-triggered polypeptides provide an AND gate; thus, for example, in some cases, the genetically modified cytotoxic immune cell is activated to kill a target cancer cell only when the target cancer cell expresses both of the two different cell surface antigens on its cell surface. In some cases, the two different antigen-triggered polypeptides provide an AND-NOT gate; thus, for example, in some cases, the genetically modified cytotoxic immune cell: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface.

The present disclosure provides a system for killing a target cancer cell, the system comprising: a) a first antigen-triggered polypeptide that binds specifically to a first target antigen present on the target cancer cell, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide. In some cases, the system provides an AND gate; thus, for example, in some cases, the first target antigen and the second target antigen are both present on the surface of a target cancer cell. In some cases, the system provides an AND-NOT gate; thus, for example, in some cases: a) the first target antigen and the second target antigen are both present on the surface of a non-cancerous cell; and b) the first target antigen, but not the second target antigen, is present on the surface of a target cancer cell. A system of the present disclosure can be introduced ex vivo into an immune cell obtained from a patient, to generate a modified immune cell; and the modified immune cell can be introduced into the patient from whom the immune cell was obtained.

The present disclosure provides a method of killing a target cancer cell in an individual. In some cases, a method of the present disclosure for killing a target cell in an individual comprises: a) introducing a system of the present disclosure into an immune cell (e.g., a CD8$^+$ T cell; an NK cell) obtained from the individual, generating a modified immune cell; and b) administering the modified immune cell to the individual, where the modified immune cell kills the target cancer cell in the individual.

The present disclosure provides a method of killing a target cancer cell in an individual. In some cases, a method of the present disclosure for killing a target cell in an individual comprises administering a genetically modified cytotoxic immune cell (e.g., a genetically modified CD8$^+$ T cell; a genetically modified NK cell) of the present disclosure to the individual, where the genetically modified immune cell kills the target cancer cell in the individual.

As noted above, a genetically modified cytotoxic immune cell of the present disclosure, and a system of the present disclosure, involve at least two antigen-triggered polypeptides that recognize two different cell surface antigens. A pair of antigen-triggered polypeptides recognizes and binds to a pair of target antigens; antigen binding activates the antigen-triggered polypeptides. Thus, a first antigen-triggered polypeptide binds a first member of a target antigen pair; and a second antigen-triggered polypeptide binds a second member of the target antigen pair. Target antigen combinations (also referred to herein as "target antigen pairs") are provided in FIG. 1. At least one of the two antigens of a target antigen pair listed in FIG. 1 is present on the surface of a target cancer cell. In some cases, the second target antigen of a target antigen pair is present on the surface of the same target cancer cell as the first target antigen of the target antigen pair. In some cases, the first target antigen of the target antigen pair is present on the surface of a target cancer cell, and the second target antigen of a target antigen pair is not present on the surface of the same target cancer cell; in these cases, both antigens of the target antigen pair are present on the surface of a non-cancerous cell. The target antigen combinations presented in FIG. 1 provide for an AND logic gate or an AND-NOT logic gate for a particular cancer cell type. Such logic being represented in FIG. 1 where an "AND" precedes or follows a target antigen present on the surface of a target cancer cell and a "NOT" precedes an antigen that that is not present on the surface of a target cancer cell, but may be present on the surface of a non-cancerous cell.

Where a target antigen pair provides for an AND logic gate, both antigens must be present on the surface of a target cancer cell in order for a genetically modified cytotoxic immune cell of the present disclosure to kill the target cancer cell, where in this case the genetically modified cytotoxic immune cell is genetically modified to express two antigen-triggered polypeptides, each recognizing one of the target antigens of the target antigen pair. For example, where a target antigen pair present in FIG. 1 is indicated as providing solely AND gate logic, both target antigens of the target antigen pair must be present on the surface of a target cancer cell in order for a genetically modified cytotoxic immune cell of the present disclosure to kill the target cancer cell; and the genetically modified cytotoxic immune cell must express both a first antigen-triggered polypeptide that specifically binds the first target antigen of the target antigen pair and a second triggered polypeptide that specifically binds the second antigen of the target antigen pair. For example, in some cases, expression of the second antigen-triggered polypeptide is induced when the first antigen-triggered polypeptide binds to the first target antigen of the target antigen pair.

Where a target antigen pair provides an AND-NOT logic gate (or, correspondingly, a NOT-AND logic gate), a genetically modified cytotoxic immune cell of the present disclosure: a) is activated to kill a target cancer cell that expresses the AND target cell surface antigen (e.g., the first target cell surface antigen), but not the NOT target cell surface antigen (e.g., the second target cell surface antigen), on its cell surface; and b) is inhibited from killing a non-cancerous cell if the non-cancerous cell expresses both the AND target cell surface antigen and the NOT target cell surface antigen on its cell surface. In these cases, the genetically modified cytotoxic immune cell must express both a first antigen-triggered polypeptide that specifically binds the AND target antigen of the target antigen pair and a second triggered polypeptide that specifically binds the NOT antigen of the target antigen pair. For example, in some cases, binding of the second antigen-triggered polypeptide to the NOT target cell surface antigen (expressed on a non-cancerous cell) inhibits T cell activation that would normally be induced by binding of the first antigen-triggered polypeptide to the AND target antigen (present on the cancer cell surface and on the non-cancerous cell surface). In this manner, unintended/undesired killing of a non-cancerous cell is reduced, because the target cancer cell expressing the AND target antigen and not the NOT target antigen will be preferentially killed over the non-cancerous cell expressing both the AND target antigen and the NOT target antigen. Since the cancer cell does not express the NOT target cell surface antigen (expressed on a non-cancerous cell), binding of the first antigen-triggered polypeptide to the AND target antigen (present on the cancer cell surface) results in activation of the genetically modified cytotoxic T cell and killing of the cancer cell.

In some cases, the first antigen-triggered polypeptide is a binding triggered transcriptional switch (BTTS) and the second antigen-triggered polypeptide is a chimeric antigen receptor (CAR). In some cases, the first antigen-triggered polypeptide is a BTTS and the second antigen-triggered polypeptide is a T cell receptor (TCR). In some cases, the first antigen-triggered polypeptide is a BTTS, and the second antigen-triggered polypeptide is a split CAR (e.g., an ON-switch CAR). In some cases, the first antigen-triggered polypeptide is a BTTS, and the second antigen-triggered polypeptide is one polypeptide chain of a split CAR (e.g., an ON-switch CAR). In some cases, the first antigen-triggered polypeptide is a BTTS, and the second antigen-triggered polypeptide is another BTTS. Any or either of the first and second antigen-triggered polypeptides of the subject systems may independently be a BTTS, a CAR, a TCR or the like. In some cases, both the first and second antigen-triggered polypeptides of the subject systems may be a BTTS, a CAR, a TCR or the like.

In some cases, the first antigen-triggered polypeptide is a CAR, and the second antigen-triggered polypeptide is an antigen-binding inhibitory polypeptide, such as e.g. an inhibitory CAR (iCAR). In some cases, the first antigen-triggered polypeptide is a TCR, and the second antigen-triggered polypeptide is an antigen-binding inhibitory polypeptide, such as e.g. an iCAR. In some cases, the first antigen-triggered polypeptide is an ON-switch CAR, and the second antigen-triggered polypeptide is an antigen-binding inhibitory polypeptide, such as e.g. an iCAR. In some cases, the first antigen-triggered polypeptide is a CAR, and the second antigen-triggered polypeptide is a BTTS. In some cases, the first antigen-triggered polypeptide is a TCR, and the second antigen-triggered polypeptide is a BTTS. In some cases, the first antigen-triggered polypeptide is an ON-switch CAR, and the second antigen-triggered polypeptide is a BTTS.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

AND Gate Target Antigen Pairs

As noted above, in some cases, expression of the second antigen-triggered polypeptide in a genetically modified immune cell is induced only when the first antigen-triggered polypeptide binds to the first target antigen of the target antigen pair, where the binding to the first target antigen activates the first antigen-triggered polypeptide. Non-limiting examples of 2-input AND gates (AND gates based on 2 target antigens) are depicted schematically in FIG. 3A.

For example, in some cases, the first antigen-triggered polypeptide is a BTTS and activation of the BTTS by binding to the first antigen (present on a target cancer cell) induces expression of the second antigen-triggered polypeptide. The second antigen-triggered polypeptide binds to the second antigen of the target antigen pair, where the second antigen is expressed on the surface of the target cancer cell. As an example, in some cases, the first antigen-triggered polypeptide is a BTTS and the second antigen-triggered polypeptide is a single chain CAR. As another example, in some cases, the first antigen-triggered polypeptide is a BTTS and the second antigen-triggered polypeptide is a TCR. For example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the TCR or the single-chain CAR.

As another example, in some cases, the first antigen-triggered polypeptide is a BTTS and activation of the BTTS by binding to the first antigen (present on a target cancer cell) induces expression of the second antigen-triggered polypeptide, where the second antigen-triggered polypeptide is a heterodimeric ("two chain" or "split") CAR comprising a first polypeptide chain and a second polypeptide chain. The heterodimeric CAR binds to the second antigen of the target antigen pair, where the second antigen is expressed on the surface of the target cancer cell. For example, in some cases, the first antigen-triggered polypeptide is a BTTS and the second antigen-triggered polypeptide is a split CAR (e.g., an ON-switch CAR). In some cases, activation of the BTTS by binding to the first antigen (present on a target cancer cell) induces expression of only the first polypeptide chain of the heterodimeric CAR; expression of the second polypeptide chain of the heterodimeric CAR can be constitutive. For example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the first polypeptide chain of the heterodimeric CAR. In some cases, activation of the BTTS by binding to the first antigen (present on a target cancer cell) induces expression of only the second polypeptide chain of the heterodimeric CAR; expression of the first polypeptide chain of the heterodimeric CAR can be constitutive. Once the first polypeptide chain of the heterodimeric CAR is produced in the cell, it heterodimerizes with the second polypeptide chain of the heterodimeric CAR. As another example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the second polypeptide chain of the heterodimeric CAR.

In AND gate systems, unintended/undesired killing of non-target cells is reduced; for example, a cell that expresses on its cell surface only one of the target antigen pair is not killed by a genetically modified cytotoxic immune cell of the present disclosure.

AND-NOT Gate Target Antigen Pairs

Figure 3B:
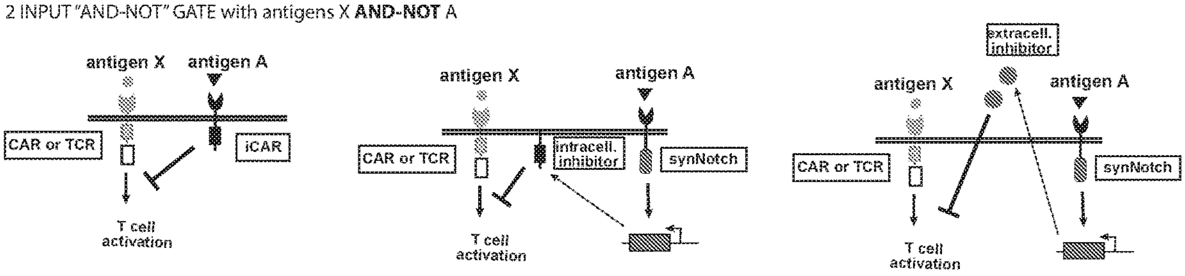
Figure 4A:
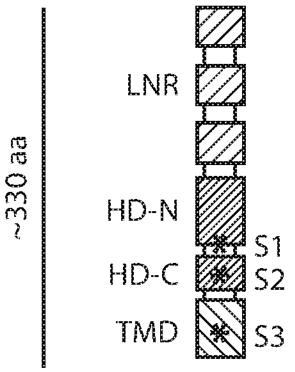
FIG. 4A-4G provide schematic depictions of exemplary synNotch receptor Notch regulatory regions.
Figure 4B:
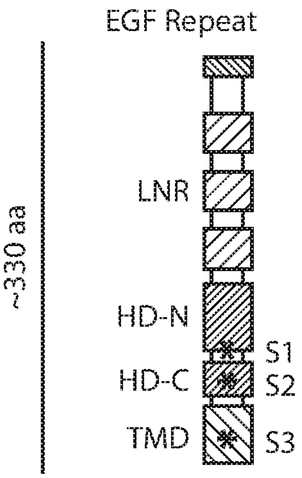
Figure 4C:
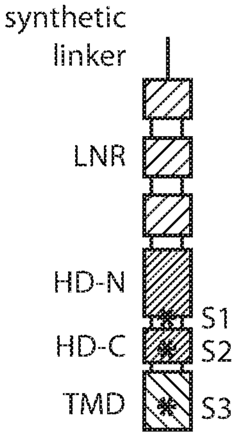
Figure 4D:
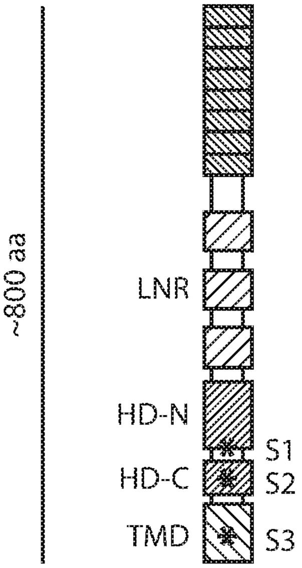
Figure 4E:
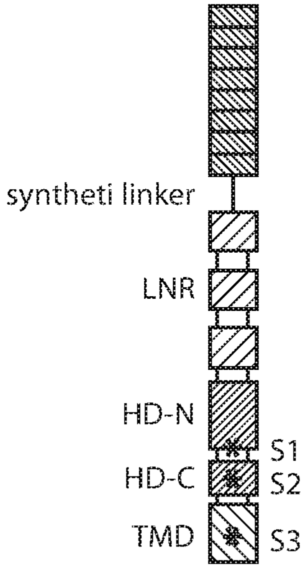
Figure 4F:
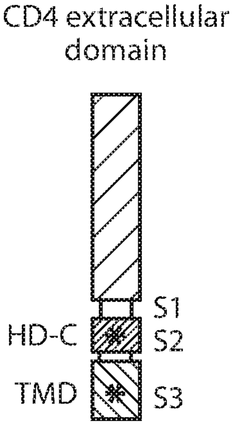
Figure 4G:
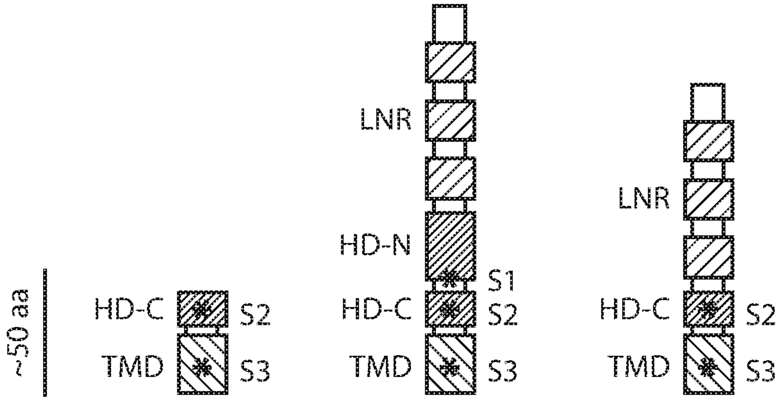
Figures 5A, 5B, 5C, 5D, 5E, 5F:
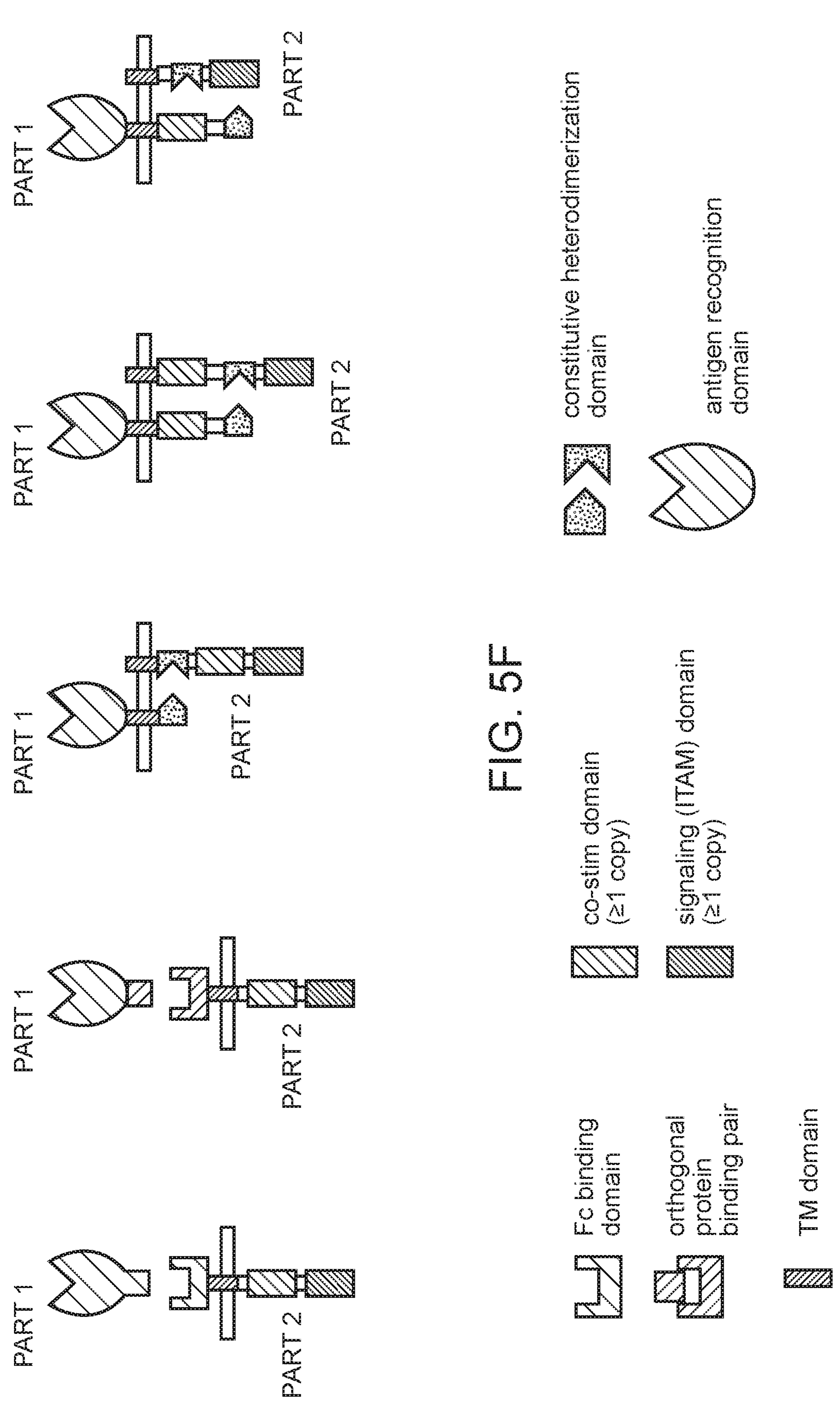
FIG. 5A-5F provide schematic depictions of exemplary split CARs.

As noted above, in some cases, where a target antigen pair provides an AND-NOT logic gate, a genetically modified cytotoxic immune cell of the present disclosure: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface; in these cases, the genetically modified cytotoxic immune cell must express both a first antigen-triggered polypeptide that specifically binds the first target antigen of the target antigen pair and a second triggered polypeptide that specifically binds the second antigen of the target antigen pair. Non-limiting examples of 2-input AND-NOT gates (AND-NOT gates based on 2 target antigens) are depicted schematically in FIG. 3B.

As an example, in some cases, the first antigen-triggered polypeptide is a CAR, and the second antigen-triggered polypeptide is an iCAR. Binding of the iCAR to the second antigen (present on the surface of a non-cancerous cell, but not on the surface of a target cancer cell) of a target antigen pair inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is an iCAR. Binding of the iCAR to the second antigen (present on the surface of a non-cancerous cell, but not on the surface of a target cancer cell) of a target antigen pair blocks or reduces T-cell activation mediated by activation of the TCR upon binding to the first antigen (present on the surface of the target cancer cell and on the surface of the non-cancerous cell) of the target antigen pair.

The above provides examples of AND-NOT gates where the inhibitory component is an iCAR; however, as will be readily understood, the inhibitory components of combinatorial antigen gates having "NOT" functionality are not so limited and may generally include any polypeptide configured to inhibit an activity, e.g., an activity induced by binding of a first activating antigen in an AND-NOT gate, including where such inhibition is conferred through the presence of an inhibitory domain. Inhibitory components of combinatorial antigen gates having "NOT" functionality may be specific for an antigen present on a non-target cell, including e.g., where such antigen is absent or present in low amounts on the surface of a target cell.

As another example, in some cases, the first antigen-triggered polypeptide is a CAR, and the second antigen-triggered polypeptide is a BTTS comprising an intracellular domain that, when released upon activation of the BTTS by binding to the second target antigen, induces expression of an intracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a BTTS comprising an intracellular domain that, when released upon activation of the BTTS by binding to the second target antigen, induces expression of an intracellular inhibitor that inhibits T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a BTTS comprising an intracellular domain that, when released upon activation of the BTTS by binding to the second target antigen, induces expression of an extracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a BTTS comprising an intracellular domain that, when released upon activation of the BTTS by binding to the second target antigen, induces expression of an extracellular inhibitor that inhibits T-cell activation mediated by activation of the TCR upon binding to the first antigen (present on the surface of the target cancer cell and on the surface of the non-cancerous cell) of the target antigen pair.

Antigen-Triggered Polypeptides

As noted above, an antigen-triggered polypeptide can be a binding triggered transcriptional switch (BTTS); a CAR; or a TCR. A CAR can be an ON-switch ("split") CAR, a single-chain CAR, an iCAR, etc. Schematic depictions of examples of antigen-triggered polypeptides are provided in FIGS. 4A-4G and FIG. 5A-5F.

Binding-Triggered Transcriptional Switches

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a binding triggered transcriptional switch (BTTS).

As used herein, a "binding-triggered transcriptional switch" (BTTS) generally refers to a synthetic modular polypeptide or system of interacting polypeptides having an extracellular domain that includes a first member of a specific binding pair that binds a binding partner (i.e., the second member of the specific binding pair; e.g., an antigen), a binding-transducer and an intracellular domain.

Upon binding of the second member of the specific binding pair to the BTTS the binding signal is transduced to the intracellular domain such that the intracellular domain becomes activated and performs some function within the cell that it does not perform in the absence of the binding signal. Certain BTTS's are described in e.g., PCT Pub. No. WO 2016/138034 as well as U.S. Pat. Nos. 9,670,281 and 9,834,608; the disclosures of which are incorporated herein by reference in their entirety.

The specific binding member of the extracellular domain generally determines the specificity of the BTTS. In some instances, a BTTS may be referred according to its specificity as determined based on its specific binding member. For example, a specific binding member having binding partner "X" may be referred to as an X-BTTS or an anti-X BTTS.

A BTTS useful in the cells, systems, methods, etc., of the present disclosure may make use of a member of a specific binding pair, i.e., specific binding member, and thus, the BTTS may be specific for an antigen as described herein. Useful specific binding members include but not limited to e.g., antigen-antibody pairs, ligand receptor pairs, scaffold protein pairs, etc., including those specific for an antigen described herein.

In some instances, the specific binding member may be an antibody and its binding partner may be an antigen to which the antibody specifically binds. In some instances, the specific binding member may be a receptor and its binding partner may be a ligand to which the receptor specifically binds. In some instances, the specific binding member may be a scaffold protein and its binding partner may be a protein to which the scaffold protein specifically binds.

Useful specific binding pairs include those specific for an antigen, including those antigens described herein. For simplicity, regardless of the actual nature of the binding pair (i.e., antigen/antibody, receptor/ligand, etc.), the member of the binding pair attached to the BTTS will be referred to herein as an antigen binding domain and the member to which it binds will be referred to as an antigen herein (i.e., regardless of whether such a molecule would otherwise be considered an "antigen" in the conventional sense). However, one of ordinary skill will readily understand that descriptions of antigen binding domain-antigen interactions can be substituted with ligand/receptor, scaffold/binding partner pair where desired as appropriate.

In some cases, the specific binding member is an antibody. The antibody can be any antigen-binding antibody-based polypeptide, a wide variety of which are known in the art. In some instances, the specific binding member is or includes a monoclonal antibody, a single chain Fv (scFv), a Fab, etc. Other antibody-based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing VaxVp) are also suitable for use.

Where the specific binding member is an antibody-based binding member, the BTTS can be activated in the presence of a binding partner to the antibody-based binding member, including e.g., an antigen specifically bound by the antibody-based binding member. In some instances, antibody-based binding member may be defined, as is commonly done in the relevant art, based on the antigen bound by the antibody-based binding member, including e.g., where the antibody-based binding member is described as an "anti-" antigen antibody, e.g., an anti-CD19 antibody. Accordingly, antibody-based binding members suitable for inclusion in a BTTS or an antigen-specific therapeutic of the present methods can have a variety of antigen-binding specificities.

The components of BTTS's, employed in the described cells, systems, methods, etc., and the arrangement of the components of the switch relative to one another will vary depending on many factors including but not limited to e.g., the desired antigen, the activity of the intracellular domain, the overall function of the BTTS, the broader arrangement of a system comprising the BTTS, etc. The first binding member may include but is not limited to e.g., those agents that bind an antigen described herein. The intracellular domain may include but is not limited e.g., those intracellular domains that activate or repress transcription at a regulatory sequence, e.g., to induce or inhibit expression of a downstream component such as an antigen-triggered polypeptide (e.g., a second antigen-triggered polypeptide).

The binding transducer of BTTS's will also vary depending on the desired method of transduction of the binding signal. Generally, binding transducers may include those polypeptides and/or domains of polypeptides that transduce an extracellular signal to intracellular signaling e.g., as performed by the receptors of various signal transduction pathways. Transduction of a binding signal may be achieved through various mechanisms including but not limited to e.g., binding-induced proteolytic cleavage, binding-induced phosphorylation, binding-induced conformational change, etc. In some instances, a binding-transducer may contain a ligand-inducible proteolytic cleavage site such that upon binding the binding-signal is transduced by cleavage of the BTTS, e.g., to liberate an intracellular domain. For example, in some instances, a BTTS may include a Notch derived cleavable binding transducer, such as, e.g., a chimeric notch receptor polypeptide (e.g., a synNotch polypeptide) as described herein.

In other instances, the binding signal may be transduced in the absence of inducible proteolytic cleavage. Any signal transduction component or components of a signaling transduction pathway may find use in a BTTS whether or not proteolytic cleavage is necessary for signal propagation. For example, in some instances, a phosphorylation-based binding transducer, including but not limited to e.g., one or more signal transduction components of the Jak-Stat pathway, may find use in a non-proteolytic BTTS.

For simplicity, BTTS's, including but not limited to chimeric notch receptor polypeptides, are described primarily as single polypeptide chains. However, BTTS's, including chimeric notch receptor polypeptides, may be divided or split across two or more separate polypeptide chains where the joining of the two or more polypeptide chains to form a functional BTTS, e.g., a chimeric notch receptor polypeptide, may be constitutive or conditionally controlled. For example, constitutive joining of two portions of a split BTTS may be achieved by inserting a constitutive heterodimerization domain between the first and second portions of the split polypeptide such that upon heterodimerization the split portions are functionally joined.

Useful BTTS's that may be employed in the subject methods include, but are not limited to modular extracellular sensor architecture (MESA) polypeptides. A MESA polypeptide comprises: a) a ligand binding domain; b) a transmembrane domain; c) a protease cleavage site; and d) a functional domain. The functional domain can be a transcription regulator (e.g., a transcription activator, a transcription repressor). In some cases, a MESA receptor comprises two polypeptide chains. In some cases, a MESA receptor comprises a single polypeptide chain. Non-limiting examples of MESA polypeptides are described in, e.g., U.S. Patent Publication No. 2014/0234851; the disclosure of which is incorporated herein by reference in its entirety.

Useful BTTS's that may be employed in the subject methods include, but are not limited to polypeptides employed in the TANGO assay. The subject TANGO assay employs a TANGO polypeptide that is a heterodimer in which a first polypeptide comprises a tobacco etch virus (Tev) protease and a second polypeptide comprises a Tev proteolytic cleavage site (PCS) fused to a transcription factor. When the two polypeptides are in proximity to one another, which proximity is mediated by a native protein-protein interaction, Tev cleaves the PCS to release the transcription factor. Non-limiting examples of TANGO polypeptides are described in, e.g., Barnea et al. (Proc Natl Acad Sci USA. 2008 Jan. 8; 105(1):64-9); the disclosure of which is incorporated herein by reference in its entirety.

Useful BTTS's that may be employed in the subject methods include, but are not limited to von Willebrand Factor (vWF) cleavage domain-based BTTS's, such as but not limited to e.g., those containing an unmodified or modified vWF A2 domain. A subject vWF cleavage domain-based BTTS will generally include: an extracellular domain comprising a first member of a binding pair; a von Willebrand Factor (vWF) cleavage domain comprising a proteolytic cleavage site; a cleavable transmembrane domain and an intracellular domain. Non-limiting examples of vWF cleavage domains and vWF cleavage domain-based BTTS's are described in Langridge & Struhl (Cell (2017) 171(6): 1383-1396); the disclosure of which is incorporated herein by reference in its entirety.

Useful BTTS's that may be employed in the subject methods include, but are not limited to chimeric Notch receptor polypeptides, such as but not limited to e.g., synNotch polypeptides (also referred to as "synNotch receptors"), non-limiting examples of which are described in PCT Pub. No. WO 2016/138034, U.S. Pat. Nos. 9,670,281, 9,834,608, Roybal et al. Cell (2016) 167(2):419-432, Roybal et al. Cell (2016) 164(4):770-9, and Morsut et al. Cell (2016) 164(4):780-91; the disclosures of which are incorporated herein by reference in their entirety.

SynNotch polypeptides are generally proteolytically cleavable chimeric polypeptides that generally include: a) an extracellular domain comprising a specific binding member; b) a proteolytically cleavable Notch receptor polypeptide comprising one or more proteolytic cleavage sites; and c) an intracellular domain. Binding of the specific binding member by its binding partner generally induces cleavage of the synNotch at the one or more proteolytic cleavage sites, thereby releasing the intracellular domain. In some instances, the instant methods may include where release of the intracellular domain triggers (i.e., induces) the production of an encoded payload, the encoding nucleic acid sequence of which is contained within the cell. Depending on the particular context, the produced payload is then generally expressed on the cell surface or secreted. SynNotch polypeptides generally include at least one sequence that is heterologous to the Notch receptor polypeptide (i.e., is not derived from a Notch receptor), including e.g., where the extracellular domain is heterologous, where the intracellular domain is heterologous, where both the extracellular domain and the intracellular domain are heterologous to the Notch receptor, etc.

Useful synNotch BTTS's will vary in the domains employed and the architecture of such domains. SynNotch polypeptides will generally include a Notch receptor polypeptide that includes one or more ligand-inducible proteolytic cleavage sites. The length of Notch receptor polypeptides will vary and may range in length from about 50 amino acids or less to about 1000 amino acids or more.

In some cases, the Notch receptor polypeptide present in a synNotch polypeptide has a length of from 50 amino acids (aa) to 1000 aa, e.g., from 50 aa to 75 aa, from 75 aa to 100 aa, from 100 aa to 150 aa, from 150 aa to 200 aa, from 200 aa to 250 aa, from 250 a to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, from 750 aa to 800 aa, from 800 aa to 850 aa, from 850 aa to 900 aa, from 900 aa to 950 aa, or from 950 aa to 1000 aa. In some cases, the Notch receptor polypeptide present in a synNotch polypeptide has a length of from 300 aa to 400 aa, from 300 aa to 350 aa, from 300 aa to 325 aa, from 350 aa to 400 aa, from 750 aa to 850 aa, from 50 aa to 75 aa. In some cases, the Notch receptor polypeptide has a length of from 310 aa to 320 aa, e.g., 310 aa, 311 aa, 312 aa, 313 aa, 314 aa, 315 aa, 316 aa, 317 aa, 318 aa, 319 aa, or 320 aa. In some cases, the Notch receptor polypeptide has a length of 315 aa. In some cases, the Notch receptor polypeptide has a length of from 360 aa to 370 aa, e.g., 360 aa, 361 aa, 362 aa, 363 aa 364 aa, 365 aa, 366 aa, 367 aa, 368 aa, 369 aa, or 370 aa. In some cases, the Notch receptor polypeptide has a length of 367 aa.

In some cases, a Notch receptor polypeptide comprises an amino acid sequence having at least 50%, at least 55%, at least 60%, at least 65%, at least 70%, at least 75%, at least 80%, at least 85%, at least 90%, at least 95%, at least 98%, at least 99%, or 100%, amino acid sequence identity to the amino acid sequence of a Notch receptor. In some instances, the Notch regulatory region of a Notch receptor polypeptide is a mammalian Notch regulatory region, including but not limited to e.g., a mouse Notch (e.g., mouse Notch1, mouse Notch2, mouse Notch3 or mouse Notch4) regulatory region, a rat Notch regulatory region (e.g., rat Notch1, rat Notch2 or rat Notch3), a human Notch regulatory region (e.g., human Notch1, human Notch2, human Notch3 or human Notch4), and the like or a Notch regulatory region derived from a mammalian Notch regulatory region and having at least 50%, at least 55%, at least 60%, at least 65%, at least 70%, at least 75%, at least 80%, at least 85%, at least 90%, at least 95%, at least 98%, at least 99%, or 100%, amino acid sequence identity to the amino acid sequence of a mammalian Notch regulatory region of a mammalian Notch receptor amino acid sequence.

Subject Notch regulatory regions may include or exclude various components (e.g., domains, cleavage sites, etc.) thereof. Examples of such components of Notch regulatory regions that may be present or absent in whole or in part, as appropriate, include e.g., one or more EGF-like repeat domains, one or more Lin12/Notch repeat domains, one or more heterodimerization domains (e.g., HD-N or HD-C), a transmembrane domain, one or more proteolytic cleavage sites (e.g., a furin-like protease site (e.g., an S1 site), an ADAM-family protease site (e.g., an S2 site) and/or a gamma-secretase protease site (e.g., an S3 site)), and the like. Notch receptor polypeptides may, in some instances, exclude all or a portion of one or more Notch extracellular domains, including e.g., Notch-ligand binding domains such as Delta-binding domains. Notch receptor polypeptides may, in some instances, include one or more non-functional versions of one or more Notch extracellular domains, including e.g., Notch-ligand binding domains such as Delta-binding domains. Notch receptor polypeptides may, in some instances, exclude all or a portion of one or more Notch intracellular domains, including e.g., Notch Rbp-associated molecule domains (i.e., RAM domains), Notch Ankyrin repeat domains, Notch transactivation domains, Notch PEST domains, and the like. Notch receptor polypeptides may, in some instances, include one or more non-functional versions of one or more Notch intracellular domains, including e.g., non-functional Notch Rbp-associated molecule domains (i.e., RAM domains), non-functional Notch Ankyrin repeat domains, non-functional Notch transactivation domains, non-functional Notch PEST domains, and the like.

Non-limiting examples of particular synNotch BTTS's, the domains thereof, and suitable domain arrangements are described in PCT Pub. Nos. WO 2016/138034, WO 2017/193059, WO 2018/039247 and U.S. Pat. Nos. 9,670,281 and 9,834,608; the disclosures of which are incorporated herein by reference in their entirety.

Domains of a useful BTTS, e.g., the extracellular domain, the binding-transducer domain, the intracellular domain, etc., may be joined directly, i.e., with no intervening amino acid residues or may include a peptide linker that joins two domains. Peptide linkers may be synthetic or naturally derived including e.g., a fragment of a naturally occurring polypeptide.

A peptide linker can vary in length of from about 3 amino acids (aa) or less to about 200 aa or more, including but not limited to e.g., from 3 aa to 10 aa, from 5 aa to 15 aa, from 10 aa to 25 aa, from 25 aa to 50 aa, from 50 aa to 75 aa, from 75 aa to 100 aa, from 100 aa to 125 aa, from 125 aa to 150 aa, from 150 aa to 175 aa, or from 175 aa to 200 aa. A peptide linker can have a length of from 3 aa to 30 aa, e.g., 3, 4, 5, 6, 7, 8, 9, 10, 11, 12, 13, 14, 15, 16, 17, 18, 19, 20, 21, 22, 23, 24, 25, 26, 27, 28, 29, or 30 aa. A peptide linker can have a length of from 5 aa to 50 aa, e.g., from 5 aa to 40 aa, from 5 aa to 35 aa, from 5 aa to 30 aa, from 5 aa to 25 aa, from 5 aa to 20 aa, from 5 aa to 15 aa or from 5 aa to 10 aa.

In some instances, a BTTS may have an extracellular domain that includes a first member of a specific binding pair that binds a second member of the specific binding pair, wherein the extracellular domain does not include any additional first or second member of a second specific binding pair. For example, in some instances, a BTTS may have an extracellular domain that includes a first antigen-binding domain that binds an antigen, wherein the extracellular domain does not include any additional antigen-binding domains and does not bind any other antigens. A subject BTTS may, in some instances, include only a single extracellular domain. Accordingly, an employed BTTS may be specific for a single antigen and only specific for the single antigen. Such, BTTS's may be referred to as a "single antigen BTTS".

BTTS's specific for a single antigen may be monovalent or multivalent (e.g., bivalent, trivalent, etc.) for the antigen. For example, in some instances, a monovalent BTTS may be employed that includes an antigen binding domain (e.g., a single antigen binding domain) for binding a single molecule of antigen. In some instances, a multivalent BTTS may be employed that includes an antigen binding domain or multiple antigen binding domains (e.g., 1, 2, 3, 4, 5, 6, etc. antigen binding domains) for binding multiple molecules of antigen.

In some instances, a BTTS may have an extracellular domain that includes the first or second members of two or more specific binding pairs. For example, in some instances, a BTTS may have an extracellular domain that includes a first antigen-binding domain and a second antigen-binding domain that are different such that the extracellular domain is specific for two different antigens. In some instances, a BTTS may have two or more extracellular domains that each includes the first or second members of two different specific binding pairs. For example, in some instances, a BTTS may have a first extracellular domain that includes a first antigen-binding domain and a second extracellular domain that includes a second antigen-binding domain where the two different antigen binding domains are each specific for a different antigen. As such, the BTTS may be specific for two different antigens.

A BTTS specific for two or more different antigens, containing either two extracellular domains or one extracellular domain specific for two different antigens, may be configured such that the binding of either antigen to the BTTS is sufficient to trigger activation of the BTTS, e.g., proteolytic cleavage of a cleavage domain of the BTTS, e.g., releasing an intracellular domain of the BTTS. Such a BTTS, capable of being triggered by any of two or more antigens, may find use as a component of a logic gate containing OR functionality. In some instances, a BTTS specific for two different antigens may be referred to as a "two-headed BTTS". BTTS's specific for multiple antigens will not be limited to only two antigens and may, e.g., be specific for and/or triggered by more than two antigens, including e.g., three or more, four or more, five or more, etc.

As summarized above, antigen binding domains of BTTS's may be substituted, amended or exchanged as desired. For example, an antigen binding domain of any antigen specific molecule, such as an antibody, may be employed as the antigen binding domain of a BTTS described herein. Correspondingly, an antigen binding domain described above as used in a CAR may be employed in other contexts, such as e.g., in a BTTS as described. As such, disclosure of any agent targeted to a specific antigen in any context herein would be understood to constitute a disclosure of the use of an antigen binding domain in any other antigen-specific polypeptide described herein as well.

CARs

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a chimeric antigen receptor. Schematic depictions of split CARs are provided in FIG. 5A-5F.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013); 5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al. Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety.

Spit CAR may be extracellularly split or intracellularly split and may or may not be conditionally heterodimerizable. For example, split CAR systems that are not conditionally heterodimerizable may contain a constitutive heterodimerization domain or other binding pair (e.g., a Fc binding pair or other orthogonal binding pair) that does not depend on the presence of one or more additional molecules for the heterodimerization that results in the formation of an active CAR from assembly of the split portions.

In some instances, an extracellularly split CAR may be split extracellularly at the antigen binding domain into two parts including e.g., where the first part of the split CAR contains an extracellular Fc binding domain that specifically binds to second part of the split CAR that contains the antigen recognition domain.

In some instances, an extracellularly split CAR may be split extracellularly at the antigen binding domain into two parts including e.g., where the first part of the split CAR contains an first part of an orthogonal protein binding pair that specifically binds to the second part of the orthogonal protein binding pair that is contained in the second part of the split CAR that contains the antigen recognition domain.

In some instances, an intracellularly split CAR may be split intracellularly proximal to the transmembrane domain into two parts including e.g., where the first part of the split CAR includes the antigen recognition domain, a transmembrane domain and an intracellular first portion of a constitutive heterodimerization domain and the second part of the split CAR includes a transmembrane domain, the second portion of the constitutive heterodimerization domain proximal to the transmembrane domain, one or more co-stimulatory domains and one or more signaling domains (e.g., ITAM domains).

In some instances, an intracellularly split CAR may be split into two parts intracellularly proximal to an intracellular domain or between two intracellular domains including e.g., where the first part of the split CAR includes the antigen recognition domain, a transmembrane domain, one or more co-stimulatory domains and an intracellular first portion of a constitutive heterodimerization domain and the second part of the split CAR includes a transmembrane domain, one or more co-stimulatory domains, one or more signaling domains (e.g., ITAM domains) and the second portion of the constitutive heterodimerization domain between the one or more co-stimulatory domains and the one or more signaling domains.

In some instances, an intracellularly split CAR may be split into two parts intracellularly between intracellular domains including e.g., where the first part of the split CAR includes the antigen recognition domain, a transmembrane domain, one or more co-stimulatory domains and an intracellular first portion of a constitutive heterodimerization domain proximal to the intracellular terminus of the first part of the split CAR and the second part of the split CAR includes a transmembrane domain, one or more signaling domains (e.g., ITAM domains) and the second portion of the constitutive heterodimerization domain between the transmembrane domain and the one or more signaling domains.

An inhibitory CAR (iCAR) expressed on an immunoresponsive cell specifically binds to an antigen, whereupon binding its antigen the iCAR inhibits the immunoresponsive cell. By "inhibits an immunoresponsive cell" or "suppresses an immunoresponsive cell" is meant induction of signal transduction or changes in protein expression in the cell resulting in suppression of an immune response (e.g., decrease in cytokine production).

Generally, but not exclusively, an iCAR is employed as a component of a bispecific CAR system where the activity of an immunostimulatory CAR (e.g., a CAR or CAR variant) is repressed by the iCAR upon binding of the iCAR to its antigen. An iCAR will generally include an extracellular domain that binds an antigen; a transmembrane domain operably linked to the extracellular domain; and an intracellular domain that activates intracellular signaling to decrease an immune response, the intracellular domain operably linked to the transmembrane domain. In some embodiments, the intracellular signaling domain is selected from the group consisting of a CTLA-4 polypeptide, a PD-1 polypeptide, a LAG-3 polypeptide, a 2B4 polypeptide, and a BTLA polypeptide. In certain embodiments, the transmembrane domain is selected from the group consisting of a CD4 polypeptide, a CD8 polypeptide, a CTLA-4 polypeptide, a PD-1 polypeptide, a LAG-3 polypeptide, a 2B4 polypeptide, and a BTLA polypeptide. In some instances, an iCAR, as described herein, may be or may be derived from one or more of the iCARs described in U.S. Patent Application Publication No. 20150376296, the disclosure of which is incorporated herein by reference in its entirety.

Any convenient extracellular binding domain (i.e., antigen binding domain) may find use in an iCAR including but not limited to e.g., a Fab, scFv, a monovalent or polyvalent ligand, etc., provided the domain is sufficient for specific binding of the iCAR to its antigen. In the contexts of therapy, the antigen binding domain of an iCAR will generally bind a healthy cell antigen in order to repress an immune response that may be otherwise triggered by presentation of a target antigen on the surface of a healthy cell. For example, in the contexts of cancer therapy, the antigen binding domain of an iCAR will generally bind a non-tumor or healthy cell antigen. For example, the extracellular domain may be a binding domain that does not bind one or more tumor antigens, including but not limited to e.g., CD19, CAIX, CEA, CD5, CD7, CD10, CD20, CD22, CD30, CD33, CD34, CD38, CD41, CD44, CD49f, CD56, CD74, CD123, CD133, CD138, a cytomegalovirus (CMV) infected cell antigen, EGP-2, EGP-40, EpCAM, erb-B2,3,4, F8P, Fetal acetylcholine receptor, folate receptor-a, GD2, GD3, HER-2, hTERT, IL-13R-.alpha.2, K-light chain, KDR, LeY, L1 cell adhesion molecule, MAGE-A1, Mesothelin, Muc-1, Muc-16, NKG2D ligands, NY-ESO-1, oncofetal antigen (h5T4), PSCA, PSMA, ROR1, TAG-72, VEGF-R2, WT-1, and the like. Antigens to which the extracellular domain of an iCAR does not bind are, however, not limited to cancer antigens and may likewise exclude any target antigen to which an immunostimulatory CAR is directed.

In some instances, the antigen binding domain of an iCAR will bind a non-tumor antigen including but not limited to e.g., CD33, CD38, a human leukocyte antigen (HLA), an organ specific antigen, a blood-brain barrier specific antigen, an Epithelial-mesenchymal transition (EMT) antigen, E-cadherin, cytokeratin, Opioid-binding protein/cell adhesion molecule (OPCML), HYLA2, Deleted in Colorectal Carcinoma (DCC), Scaffold/Matrix attachment region-binding protein 1 (SMARI), cell surface carbohydrate, mucin type O-glycan, etc.

In certain instances, an antigen to which the extracellular domain of an iCAR binds may be an antigen listed in FIG. 1, which antigen is described as the "NOT" portion of an antigen logic gate. For example, useful antigens to which the extracellular domain of an iCAR may bind include e.g., ADAM29, ADCY4, ADRB2, ALDH1A1, ATP13A4, ATP1A2, AXL, B4GALNT1, Clorf210, CADM1, CADM3, CD101, CD274, CD33, CD36, CD70, CD80, CD86, CDH1, CDH10, CLCNKB, CLDN18, CLEC4M, CYP4F12, EGFR, EPCAM, EPHB1, ERBB2, FAP, FOLH1, FXYD3, GPBAR1, GPC3, GPM6A, GPM6B, GPR1, HEG1, HTR1E, IL3RA, ITGB6, KCNB1, KCNJ1, KCNJ5, LlCAM, LIFR, LINGO1, LRRC8E, LRRTM1, LSR, MAGEA1, MAL, MET, MUC1, NALCN, NDRG4, NPFFR1, NRP1, NTRK2, NTRK3, P2RX1, PCDH9, PDGFRA, PMEL, PROM1, RAMP3, ROR1, ROR2, SCN3B, SCN4A, SCN4B, SCNN1A, SEMA5A, SEZ6, SLC13A4, SLC17A2, SLC22A2, SLC26A9, SLC2A12, SLC46A1, SLC6A14, SLC6A4, SLC8A3, STAB2, SYT13, TGFBR3, THY1, TMEM100, TMEM150B, TMEM17, TPBG, TRPM8, TSPAN1, and WLS.

TCRs

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a T-cell receptor (TCR).

A TCR generally includes an alpha chain and a beta chain; and recognizes antigen when presented by a major histocompatibility complex. In some cases, the TCR is an engineered TCR. Any engineered TCR having immune cell activation function can be induced using a method of the present disclosure. Such TCRs include, e.g., antigen-specific TCRs, Monoclonal TCRs (MTCRs), Single chain MTCRs, High Affinity CDR2 Mutant TCRs, CD1-binding MTCRs, High Affinity NY-ESO TCRs, VYG HLA-A24 Telomerase TCRs, including e.g., those described in PCT Pub Nos. WO 2003/020763, WO 2004/033685, WO 2004/044004, WO 2005/114215, WO 2006/000830, WO 2008/038002, WO 2008/039818, WO 2004/074322, WO 2005/113595, WO 2006/125962; Strommes et al. Immunol Rev. 2014; 257(1):145-64; Schmitt et al. Blood. 2013; 122(3):348-56; Chapuls et al. Sci Transl Med. 2013; 5(174):174ra27; Thaxton et al. Hum Vaccin Immunother. 2014; 10(11):3313-21 (PMID:25483644); Gschweng et al. Immunol Rev. 2014; 257(1):237-49 (PMID:24329801); Hinrichs et al. Immunol Rev. 2014; 257(1):56-71 (PMID:24329789); Zoete et al. Front Immunol. 2013; 4:268 (PMID:24062738); Marr et al. Clin Exp Immunol. 2012; 167(2):216-25 (PMID:22235997); Zhang et al. Adv Drug Deliv Rev. 2012; 64(8):756-62 (PMID:22178904); Chhabra et al. Scientific World Journal. 2011; 11:121-9 (PMID:21218269); Boulter et al. Clin Exp Immunol. 2005; 142(3):454-60 (PMID:16297157); Sami et al. Protein Eng Des Sel. 2007; 20(8):397-403; Boulter et al. Protein Eng. 2003; 16(9):707-11; Ashfield et al. IDrugs. 2006; 9(8):554-9; Li et al. Nat Biotechnol. 2005; 23(3):349-54; Dunn et al. Protein Sci. 2006; 15(4):$710^{-21}$; Liddy et al. Mol Biotechnol. 2010; 45(2); Liddy et al. Nat Med. 2012; 18(6):980-7; Oates, et al. Oncoimmunology. 2013; 2(2):e22891; McCormack, et al. Cancer Immunol Immunother. 2013 April; 62(4):773-85; Bossi et al. Cancer Immunol Immunother. 2014; 63(5):437-48 and Oates, et al. Mol Immunol. 2015 October; 67(2 Pt A):67-74; the disclosures of which are incorporated herein by reference in their entirety.

Antigen-Binding Inhibitory Polypeptides

In some cases, an antigen-triggered polypeptide produced in a genetically modified immune cell of the present disclosure, or present in a system of the present disclosure, or encoded by a nucleotide sequence in a nucleic acid present in a system of the present disclosure, may be an inhibitory polypeptide. The term "antigen-binding inhibitory polypeptide", as used herein, will generally describe a polypeptide, specific for an antigen, that upon binding the antigen inhibits the activity of a second polypeptide (e.g., an activating antigen-specific polypeptide, such as a CAR or TCR or other synthetic stimulatory immune cell receptor) and/or an activity of a cell (e.g., immune activation). iCARs, as described above, are an example of an antigen-binding inhibitory polypeptide; however, the term antigen-binding inhibitory polypeptide is not so limited.

Antigen-binding inhibitory polypeptides will vary and will generally function to mediate repression of an activated or activatable immune cell, including e.g., an immune cell expressing a stimulatory receptor, such as a CAR or TCR. An antigen-binding inhibitory polypeptide will include an inhibitory domain that functions to repress immune cell activation, including e.g., immune cell activation attributed to a stimulatory receptor, such as a CAR or TCR. Domains useful as inhibitory domains will vary depending on the particular context of immune cell activation and repression, including e.g., the particular type of activated cell to be repressed and the desired degree of repression. Exemplary non-limited examples of inhibitory domains include but are not limited to domains and motifs thereof derived from immune receptors including, e.g., co-inhibitory molecules, immune checkpoint molecules, immune tolerance molecules, and the like.

Suitable intracellular inhibitory domains may be any functional unit of a polypeptide as short as a 3 amino acid linear motif and as long as an entire protein, where size of the inhibitory domain is restricted only in that the domain must be sufficiently large as to retain its function and sufficiently small so as to be compatible with the other components of the polypeptide. Accordingly, an inhibitory domain may range in size from 3 amino acids in length to 1000 amino acids or more and, in some instances, can have a length of from about 30 amino acids to about 70 amino acids (aa), e.g., an inhibitory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, an inhibitory domain can have a length of from about 70 aa to about 100 aa, from about 100 aa to about 200 aa, or greater than 200 aa.

In some instances, "co-inhibitory domains" find use in the subject polypeptides. Such co-inhibitory domains are generally polypeptides derived from receptors. Co-inhibition generally refers to the secondary inhibition of primary antigen-specific activation mechanisms which prevents co-stimulation. Co-inhibition, e.g., T cell co-inhibition, and the factors involved have been described in Chen & Flies. *Nat Rev Immunol* (2013) 13(4):227-42 and Thaventhiran et al. *J Clin Cell Immunol* (2012) S12, the disclosures of which are incorporated herein by reference in their entirety. In some embodiments, co-inhibitory domains homodimerize. In some instances, useful co-inhibitory domains have been modified to constitutively dimerize, including constitutively homodimerize. A subject co-inhibitory domain can be an intracellular portion of a transmembrane protein (i.e., the co-inhibitory domain can be derived from a transmembrane protein). Non-limiting examples of suitable co-inhibitory polypeptides include, but are not limited to, CTLA-4 and PD-1. In some instances, a co-inhibitory domain, e.g., as used in a subject polypeptide may include a co-inhibitory domain selected from PD-1, CTLA4, HPK1, SHP1, SHP2, Sts1 and Csk. In some instances, a co-inhibitory domain of subject polypeptide comprises an amino acid sequence having at least about 75%, at least about 80%, at least about 85%, at least about 90%, at least about 95%, at least about 98%, or 100% amino acid sequence identity to a co-inhibitory domain as described herein.

In some instances, an antigen-binding inhibitory polypeptide may include a domain of a dimerization pair, such as e.g., a synthetic immune cell receptor (ICR) repressor useful as a component of a heteromeric, conditionally repressible synthetic ICR. Components of a heteromeric, conditionally repressible synthetic ICR may include a synthetic stimulatory ICR and a synthetic ICR repressor, where e.g., the synthetic stimulatory ICR and the synthetic ICR repressor specifically bind the antigens of an antigen pair described herein. Heteromeric, conditionally repressible synthetic ICRs, and components thereof, are described in PCT Application No. PCT/US2016/062612; the disclosure of which is incorporated herein by reference in its entirety.

Polyspecific-Immune-Inducing Polypeptides

The present disclosure includes polyspecific-immune-inducing polypeptides having specificity for the antigens of an antigen logic pair described herein. By "polyspecific-immune-inducing polypeptide" is generally meant a single polypeptide having specificity for two or more distinct antigens that, when bound to one or more of the antigens to which the polyspecific-immune-inducing polypeptide binds, induces an immune response in a subject. The multi-specificity of a polyspecific-immune-inducing polypeptide (PIIP) may vary and may include but is not limited to e.g., bispecific-immune-inducing polypeptides, trispecific-immune-inducing polypeptides, and the like. For example, in some instances, a PIIP may be a bispecific-immune-inducing polypeptide that is a single polypeptide having specificity for two distinct antigens. Such a bispecific PIIP, when administered and bound to one or both of the antigens, may induce an immune response in a subject. In some instances, an immune response induced by antigen binding of a PIIP may only be induced when the PIIP is bound to all of the antigens (e.g., both of the antigens in the case of a bispecific PIIP) to which the PIIP is specific. In some instances, an immune response induced by antigen binding of a PIIP may be induced when the PIIP is bound to less than all of the antigens (e.g., one of the two antigens in the case of a bispecific PIIP) to which the PIIP is specific.

As such, the described PIIPs of the present disclosure may provide for AND and/or OR logic gate functionality. In some instances, a PIIP of the present disclosure may induce an immune response to a cell expressing one antigen to which the PIIP is specific. In some instances, a PIIP of the present disclosure may induce an immune response to a cell expressing all antigens to which the PIIP is specific. In some instances, the immune response induced by a PIIP bound to two or more, including e.g., all, of the antigens to which the PIIP is specific is enhanced relative to any immune response induced by the PIIP due to binding one antigen to which the PIIP is specific. The enhancement due to multiple antigen binding may vary and may be at least 10% greater, including but not limited to e.g., at least 15% greater, at least 20% greater, at least 30% greater, at least 40% greater, at least 50% greater, at least 60% greater, at least 70% greater, at least 80% greater, at least 90% greater, at least 2-fold greater, at least 3-fold greater, etc., than single antigen binding. In some instances, an enhanced immune response due to binding two or more, including e.g., all, of the antigens to which the PIIP is specific is synergistically increased. For example, in some instances, the enhanced immune response induced by a PIIP of the present disclosure binding two or more, including e.g., all, of the antigens to which the PIIP is specific may be greater than the mere additive effect of comparable immune-inducing polypeptides directed to each antigen individually. Immune responses, including enhanced immune responses, resulting from PIIP antigen binding may be evaluated using any convenient and appropriate method, including but not limited to e.g., methods measuring immune activation, methods measuring immune-mediated toxicity, and the like.

Antigen combinations useful in a PIIP of the present disclosure will vary and may include e.g., combinations of PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EPHA2, NRCAM and ERBB2, NRCAM and IL13RA2, CLDN15 and GPC3, CDH6 and CA9, CSF3R and CD70, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, BAMBI and B4GALNT1, C11orf24 and KDR, GPR19 and ERBB2, ST3GAL5 and FAP, TNFSF9 and MET, DIABLO and B4GALNT1, DIABLO and DLL3, DIABLO and GPC3, DIABLO and MSLN, SCN3A and GPC3, ADAM12 and CD80, ADAM12 and CD86, IL2RA and EGFR, KISS1R and EGFR, ITGB8 and FOLR1, KCNA6 and FOLR1, KCNK15 and FOLR1, PTH2R and FOLR1, RET and FOLR1, GP2 and MSLN, GP2 and PSCA, KCNE4 and CLDN18, NOX4 and PSCA, PPAPDC1A and PSCA, TNFSF4 and CLDN18, TREM2 and PSCA, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, CD99 and B4GALNT1, CDH11 and B4GALNT1, HTRA2 and B4GALNT1, NRCAM and PROM1, NRCAM and TSPAN11, CLDN2 and DLL4, CXCL9 and DLL4, F2RL2 and DLL4, MUC13 and DKK1, VSIG1 and DLL4, CRB1 and IGFLR1, CRB1 and PROM1, NLGN4X and PROM1, SLC1A3 and PROM1, AFP and ALCAM, AFP and CNNM3, AFP and ERBB3, AFP and LRRC8D, AFP and SLC38A6, ADIPOR2 and MAGEA1, BCAP31 and MAGEA1, SLC5A6 and MAGEA1, L1CAM and DIABLO, LRRTM1 and SLC28A3, LRRTM1 and VTCN1, PIRT and VTCN1, SSX1 and VTCN1, NOX4 and CEACAM6, ATP9A and NRP1, CDH7 and NRP1, TSPAN1 and NRP1, CLDN2 and PCDHB10, ENPEP and ROR2, ENPP3 and ROR2, EPHA7 and SLCO4C1, MAGT1 and ROR2, or SLC3A1 and ROR2. In some instances, a PIIP of the present disclosure may include antigen binding domains that specifically bind the antigens of an antigen combination listed above, including but not limited to e.g., wherein the antigen comprises an amino acid sequence having at least 85%, at least 90%, at least 95%, at least 98%, at least 99%, or 100%, amino acid sequence identity to an amino acid sequence of the antigen provided herein.

In some instances, antigen combinations useful in a PIIP of the present disclosure may be selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, PTPRZ1 and DLL3, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EGFR, NRCAM and EPHA2, NRCAM and ERBB2, NRCAM and IL13RA2, CLDN15 and GPC3, CDH6 and CA9, CSF3R and CD70, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EGFR, CRB1 and EPHA2, GPM6A and GPC3, GRIK5 and ERBB2, ITGB8 and IL13RA2, NLGN4X and EGFR, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, BAMBI and B4GALNT1, C11orf24 and KDR, GPR19 and ERBB2, ST3GAL5 and FAP, TNFSF9 and MET, DIABLO and B4GALNT1, DIABLO and DLL3, DIABLO and GPC3, DIABLO and MSLN, GPR19 and KDR, SCN3A and GPC3, ADAM12 and CD80, ADAM12 and CD86, IL2RA and EGFR, KISS1R and EGFR, ITGB8 and FOLR1, KCNA6 and FOLR1, KCNK15 and FOLR1, PTH2R and FOLR1, RET and FOLR1, GP2 and MSLN, GP2 and PSCA, KCNE4 and CLDN18, NOX4 and PSCA, PPAPDC1A and PSCA, TNFSF4 and CLDN18, TREM2 and PSCA, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, CD99 and B4GALNT1, CDH11 and B4GALNT1, HTRA2 and B4GALNT1, NRCAM and PROM1, and NRCAM and TSPAN11. In some instances, a PIIP of the present disclosure may include antigen binding domains that specifically bind the antigens of an antigen combination listed above, including but not limited to e.g., wherein the antigen comprises an amino acid sequence having at least 85%, at least 90%, at least 95%, at least 98%, at least 99%, or 100%, amino acid sequence identity to an amino acid sequence of the antigen provided herein.

In some instances, antigen combinations useful in a PIIP of the present disclosure may be selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, PTPRZ1 and DLL3, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EGFR, NRCAM and EPHA2, NRCAM and ERBB2, NRCAM and IL13RA2, CLDN15 and GPC3, and CDH6 and CA9. In some instances, a PIIP of the present disclosure may include antigen binding domains that specifically bind the antigens of an antigen combination listed above, including but not limited to e.g., wherein the antigen comprises an amino acid sequence having at least 85%, at least 90%, at least 95%, at least 98%, at least 99%, or 100%, amino acid sequence identity to an amino acid sequence of the antigen provided herein.

In some instances, antigen combinations useful in a PIIP of the present disclosure may be selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, PTPRZ1 and DLL3, FAP and CD274, FCRL5 and EGFR, MSLN and FAP, FAP and PSCA, CD70 and CA9, CD70 and FOLR1, and BIRC5 and B4GALNT1. In some instances, a PIIP of the present disclosure may include antigen binding domains that specifically bind the antigens of an antigen combination listed above, including but not limited to e.g., wherein the antigen comprises an amino acid sequence having at least 85%, at least 90%, at least 95%, at least 98%, at least 99%, or 100%, amino acid sequence identity to an amino acid sequence of the antigen provided herein.

In some instances, antigen combinations useful in a PIIP of the present disclosure may include e.g., an antigen combination selected from those combinations depicted in FIG. 6, FIG. 7, and FIG. 8. The individual antigens, including representative amino acid sequences thereof may be found in PCT Pub. WO 2017/192059 A1, the disclosure of which is incorporated by reference herein in its entirety. Antigen binding domains of the subject PIIP of the present disclosure may, in some instances, specifically bind an antigen polypeptide comprising an amino acid sequence having at least 85%, at least 90%, at least 95%, at least 98%, at least 99%, or 100%, amino acid sequence identity to an amino acid sequence of an antigen set forth in PCT Pub. WO 2017/192059 A1.

Useful PIIPs of the present disclosure may be specific for a target cancer cell. For example, a PIIP of the present disclosure may employ an antigen combination to target a cancer cell, where the targeted cancer may correspond with the cancer identified in FIG. 1, FIG. 6, FIG. 7, or FIG. 8 for the particular antigen combination employed.

Non-limiting examples of antigen combinations useful in a PIIP targeting a glioblastoma cell, for example, may be selected from: PTPRZ1 and IL13RA2, CA9 and IL13RA2, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and DLL3, PTPRZ1 and EPHA2, PTPRZ1 and GPC3, PTPRZ1 and MSLN, PTPRZ1 and ROR1, PTPRZ1 and B4GALNT1, PTPRZ1 and ERBB2, BCAN and IL13RA2, BCAN and DLL3, BCAN and EPHA2, BCAN and GPC3, BCAN and MSLN, BCAN and ROR1, BCAN and EGFR, BCAN and MUC1, BCAN and B4GALNT1, BCAN and ERBB2, MLC1 and IL13RA2, MLC1 and DLL3, MLC1 and EPHA2, MLC1 and GPC3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NLGN3 and B4GALNT1, NLGN3 and ERBB2, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and IL13RA2, AQP4 and DLL3, AQP4 and EPHA2, AQP4 and GPC3, AQP4 and MSLN, AQP4 and ROR1, AQP4 and MUC1, AQP4 and B4GALNT1, AQP4 and ERBB2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, and CRB1 and IGFLR1. In some instances, a PIIP of the present disclosure may include antigen binding domains that specifically bind the antigens of an antigen combination listed above, including but not limited to e.g., wherein the antigen comprises an amino acid sequence having at least 85%, at least 90%, at least 95%, at least 98%, at least 99%, or 100%, amino acid sequence identity to an amino acid sequence of the antigen provided herein.

The PIIP of the present disclosure will generally include two or more antigen binding domains and at least one portion that functions to induce an immune response. Useful immune-inducing portions of the subject PIIPs will vary and may be derived from various immune-inducing molecules, such as but not limited to e.g., chimeric antigen receptors (CARs), T cell receptors (TCRs), antibodies, and the like. Correspondingly, in some instances, a PIIP of the present disclosure may be a polyspecific CAR, including but not limited to e.g., a bispecific CAR. In some instances, a PIIP of the present disclosure may be a polyspecific TCR, including but not limited to e.g., a bispecific TCR. In some instances, a PIIP of the present disclosure may be a polyspecific antibody, including but not limited to e.g., a bispecific antibody.

The immune response induced by a PIIP bound to antigens of an antigen combination described herein may vary and may depend on the nature of immune-inducing polypeptide employed. For example, in some instances, a PIIP of the present disclosure may be a polyspecific chimeric antigen receptor (CAR) and the immune response induced may be a CAR-specific immune response. CAR-specific immune responses include an immune response induced by the CAR binding its target(s) and signaling through an intracellular signaling domain of the CAR. The results of a CAR-specific immune response may vary and may include e.g., immune activation of an immune cell expressing the CAR, increased proliferation of an immune cell expressing the CAR, secretion and/or expression (including increased secretion and/or expression) of an immune molecule (e.g., a cytokine) by an immune cell expressing the CAR, increased cytotoxic activity of an immune cell expressing the CAR, increased killing of a cell to which the CAR is targeted, etc.

In some instances, a polyspecific CAR of the present disclosure may be derived from a previously investigated or otherwise available CAR, e.g., by replacing or amending the antigen-binding portion of the previously investigated or otherwise available CAR with one or more antigen binding domains such that the resulting polyspecific CAR is specific for the desired antigen combination, including e.g., an antigen combination described herein. Put another way, in some instances, an existing CAR may be reconfigured to be a polyspecific CAR that is polyspecific for an antigen combination described herein. In some instances, a bispecific CAR may be reconfigured to be polyspecific for the antigens of an antigen combination as described herein. Useful bispecific CARs that may be reconfigured accordingly, include but are not limited to e.g., those bispecific CARs described in Grada et al., Mol Ther Nucleic Acids. (2013) 2:e105; Qin et al. Blood (2015) 126:4427; Liu et al. J Virol. (2015) 89(13):6685-94; Hegde et al. Journal for ImmunoTherapy of Cancer (2015) 3(Suppl 2):03; US Patent Application Pub. Nos. 20180311269, 20180230225, 20180079824, 20170107285, 20170073423, 20160303230, 20160207989, 20150038684, and 20130280220; the disclosures of which are incorporated herein by reference in their entirety.

In some instances, a PIIP of the present disclosure may be a polyspecific TCR and the immune response induced may be a TCR-specific immune response. TCR-specific immune responses include an immune response induced by the TCR binding its target(s) and signaling through an intracellular signaling domain of the TCR. The results of a TCR-specific immune response may vary and may include e.g., immune activation of an immune cell expressing the TCR, increased proliferation of an immune cell expressing the TCR, secretion and/or expression (including increased secretion and/or expression) of an immune molecule (e.g., a cytokine) by an immune cell expressing the TCR, increased cytotoxic activity of an immune cell expressing the TCR, increased killing of a cell to which the TCR is targeted, etc.

In some instances, a polyspecific TCR of the present disclosure may be derived from a previously investigated or otherwise available TCR, e.g., by replacing or amending the antigen-binding portion of the previously investigated or otherwise available TCR with one or more antigen binding domains such that the resulting polyspecific TCR is specific for the desired antigen combination, including e.g., an antigen combination described herein. Put another way, in some instances, an existing TCR may be reconfigured to be a polyspecific TCR that is polyspecific for an antigen combination described herein. In some instances, a bispecific TCR may be reconfigured to be polyspecific for the antigens of an antigen combination as described herein. Useful bispecific TCRs that may be reconfigured accordingly, include but are not limited to e.g., US Patent Application Pub. Nos. 20180311269, 20180258422, 20180201926, 20170268056, 20170015727, 20160355567, 20160244825, 20160213750, 20140242025, 20140205560, 20140134128, 20130040836, 20120177595, 20100233167, and 20100009863; the disclosures of which are incorporated herein by reference in their entirety.

In some instances, a PIIP of the present disclosure may be a polyspecific antibody and the immune response induced may be an antibody-specific immune response. Antibody-specific immune responses induced by a PIIP of the present disclosure will vary and may include e.g., antibody-dependent cellular cytotoxicity (ADCC) immune responses, complement-dependent cytotoxicity (CDC) immune responses, and the like. Antibody-specific immune responses include an immune response induced by the antibody binding its target(s) and, e.g., ADCC and/or CDC immune responses dependent thereon. The results of an antibody-specific immune response may vary and may include e.g., cell-mediated lysis of a target cell bound by the antibody, membrane complex-mediated lysis of a target cell bound by the antibody, and the like.

Immune modulation by polyspecific antibodies is not limited to modulation through ADCC and CDC pathways. In some instances, immunomodulation by an antibody can be Fc-dependent or Fc-independent and can include increased uptake of antigen via FcR on antigen-presenting cells, differential engagement of stimulatory versus inhibitory FcR, FcR-dependent enhancement of MHC class I-restricted cross-presentation, alterations in proteolysis and antigen processing, a shift in presentation of class II-restricted T-cell determinants, changes in cytokine expression by antigen-presenting cells and/or T cells, masking of dominant epitopes by the antibody, exposure of cryptic epitopes induced by antibody binding, enhanced germinal center formation and generation of strong recall responses, changes in usage of germline-encoded VH genes, induction of somatic hypermutation. and the like. See e.g., Brady L J Infect Immun (2005) 73(2): 671-678; the disclosure of which is incorporated herein by reference in its entirety.

In some instances, a polyspecific antibody of the present disclosure may be derived from a previously investigated or otherwise available antibody, e.g., by replacing or amending the antigen-binding portion of the previously investigated or otherwise available antibody with one or more antigen binding domains such that the resulting polyspecific antibody is specific for the desired antigen combination, including e.g., an antigen combination described herein. Put another way, in some instances, an existing antibody may be reconfigured to be a polyspecific antibody that is polyspecific for an antigen combination described herein.

Useful antibodies that may be reconfigured as a polyspecific antibody having polyspecificity for an antigen combination described herein include but are not limited therapeutic antibodies, such as e.g., 8H9, Abagovomab, Abciximab, Abituzumab, Abrilumab, Actoxumab, Aducanumab, Afelimomab, Afutuzumab, Alacizumab pegol, ALD518, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab/tocilizumab, Atorolimumab, Bapineuzumab, Basiliximab, Bavituximab, Bectumomab, Begelomab, Benralizumab, Bertilimumab, Besilesomab, Bevacizumab/Ranibizumab, Bezlotoxumab, Biciromab, Bimagrumab, Bimekizumab, Bivatuzumab mertansine, Blosozumab, Bococizumab, Brentuximabvedotin, Brodalumab, Brolucizumab, Brontictuzumab, Cantuzumab mertansine, Cantuzumab ravtansine, Caplacizumab, Capromab pendetide, Carlumab, Catumaxomab, cBR96-doxorubicin immunoconjugate, Cedelizumab, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Derlotuximab biotin, Detumomab, Dinutuximab, Diridavumab, Dorlimomab aritox, Drozitumab, Duligotumab, Dupilumab, Durvalumab, Dusigitumab, Ecromeximab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Erlizumab, Ertumaxomab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gevokizumab, Girentuximab, Glembatumumab vedotin, Gomiliximab, Guselkumab, Ibalizumab, Ibalizumab, Icrucumab, Idarucizumab, Igovomab, IMAB362, Imalumab, Imciromab, Imgatuzumab, Inclacumab, Indatuximab ravtansine, Indusatumab vedotin, Inolimomab, Inotuzumab ozogamicin, Intetumumab, Iratumumab, Isatuximab, Itolizumab, Ixekizumab, Keliximab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Margetuximab, Maslimomab, Matuzumab, Mavrilimumab, Metelimumab, Milatuzumab, Minretumomab, Mirvetuximab soravtansine, Mitumomab, Mogamulizumab, Morolimumab, Morolimumab immune, Motavizumab, Moxetumomab pasudotox, Muromonab-CD3, Nacolomab tafenatox, Namilumab, Naptumomab estafenatox, Narnatumab, Nebacumab, Necitumumab, Nemolizumab, Nerelimomab, Nesvacumab, Nofetumomab merpentan, Obiltoxaximab, Obinutuzumab, Ocaratuzumab, Odulimomab, Olaratumab, Olokizumab, Onartuzumab, Ontuxizumab, Opicinumab, Oportuzumab monatox, Orticumab, Otlertuzumab, Oxelumab, Ozanezumab, Ozoralizumab, Pagibaximab, Palivizumab, Pankomab, Panobacumab, Parsatuzumab, Pascolizumab, Pasotuxizumab, Pateclizumab, Patritumab, Perakizumab, Pexelizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Rilotumumab, Rinucumab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teprotumumab, Tesidolumab, Tetulomab, TGN1412, Ticilimumab/tremelimumab, Tigatuzumab, Tildrakizumab, TNX-650, Toralizumab, Tosatoxumab, Tovetumab, Tralokinumab, TRBS07, Tregalizumab, Trevogrumab, Tucotuzumab celmoleukin, Tuvirumab, Ublituximab, Ulocuplumab, Urelumab, Urtoxazumab, Vandortuzumab vedotin, Vantictumab, Vanucizumab, Vapaliximab, Varlilumab, Vatelizumab, Veltuzumab, Vepalimomab, Vesencumab, Visilizumab, Vorsetuzumab mafodotin, Votumumab, Zalutumumab, Zanolimumab, Zatuximab, Ziralimumab, Zolimomab aritox, and the like.

Immune activation, through binding of a PIIP to one or more antigens for which the PIIP is polyspecific, may result in various outcomes. For example, in some instances, specific binding may increase production of a cytokine by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of cytokine produced in the absence of binding the antigen(s). Cytokines whose production can be increased include, but are not limited to, IL-2, interferon gamma (IFN-γ), tumor necrosis factor-alpha (TNF-α), IL-15, IL-12, IL-4, IL-5, IL-10, and the like.

In some instances, specific binding may increase secretion of a cytokine by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of cytokine secreted in the absence of binding the antigen(s).

In some instances, specific binding may increase expression of an immune activation marker by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared with the amount of immune activation marker expression in the absence of binding the antigen(s). Useful immune activation markers include but are not limited to e.g., cytokines, CD69, NFAT, and the like.

In some instances, specific binding may increase cytotoxic activity by at least about 10%, at least about 15%, at least about 20%, at least about 25%, at least about 30%, at least about 40%, at least about 50%, at least about 75%, at least about 2-fold, at least about 2.5-fold, at least about 5-fold, at least about 10-fold, or more than 10-fold, compared to the cytotoxic activity in the absence of binding the antigen(s).

In some instances, specific binding may reduce one or more of tumor growth rate, cancer cell number, and tumor mass, by at least about 5%, at least about 10%, at least about 15%, at least about 20%, at least about 25%, at least about 30%, at least about 40%, at least about 50%, at least about 60%, at least about 70%, at least about 80%, at least about 90%, or more, compared to the tumor growth rate, cancer cell number, or tumor mass in the absence of binding the antigen(s).

Administration of a PIIPs of the present disclosure may vary and any convenient and appropriate method of administration may be employed. For example, in some instances, a PIIP may be directly administered to a subject in need thereof. For example, a PIIP, such as but not limited to a polyspecific antibody, may be directly administered to a subject, e.g., by injection, perfusion, or the like, in an appropriate pharmaceutical excipient. In some instances, a cell genetically modified to express a PIIP, e.g., a polyspecific CAR, a polyspecific TCR, a polyspecific antibody, etc., may be administered to a subject in need thereof. Accordingly, methods of the present disclosure include e.g., methods of killing a target cancer cell in an individual by administering to the individual an effective amount of a PIIP, including where the administering includes administering to the individual an effective amount of cytotoxic immune cells genetically modified to produce the PIIP. As such, the present disclosure also includes genetically modified cytotoxic immune cells, e.g., cells modified in vitro, ex vivo, or the like, where the cytotoxic immune cells are genetically modified to produce a PIIP as described herein.

Genetically Modified Immune Cells

The present disclosure provides a cytotoxic immune cell genetically modified to produce two antigen-triggered polypeptides, each recognizing a different cell surface antigen.

To generate a genetically modified cytotoxic immune cell of the present disclosure, a parent cytotoxic immune cell is genetically modified to produce: a) a first antigen-triggered polypeptide that binds specifically to a first target cell surface antigen present on a target cancer cell; and b) a second antigen-triggered polypeptide that binds specifically to a second target cell surface antigen. Suitable parent cytotoxic immune cells include $CD8^+$ T cells, natural killer (NK) cells, and the like. Thus, in some cases, a genetically modified cytotoxic immune cell of the present disclosure is a genetically modified $CD8^+$ T cell. In other cases, a genetically modified cytotoxic immune cell of the present disclosure is a genetically modified NK cell.

In some cases, the target cancer cell is an acute myeloid leukemia cell, an anaplastic lymphoma cell, an astrocytoma cell, a B-cell cancer cell, a bone tumor cell, a breast cancer cell, a colon cancer cell, a gastric cancer cell, a glioblastoma cell, a glioma cell, a hepatocellular carcinoma cell, a leiomyosarcoma cell, a liposarcoma cell, a lung cancer cell, a mantle cell lymphoma cell, a melanoma cell, a neuroblastoma cell, a non small cell lung cancer cell, an oligodendroglioma cell, an ovarian cancer cell, a pancreatic cancer cell, a pancreatic ductal carcinoma cell, a prostate cancer cell, a renal cancer cell, a renal cell carcinoma cell, a sarcoma cell, a soft tissue sarcoma cell, a stomach cancer cell, or the like.

In some cases, a genetically modified cytotoxic immune cell of the present disclosure is genetically modified to express a first antigen-triggered polypeptide and a second antigen-triggered polypeptide that bind to antigens of a 2-input AND-gate target antigen pair. Non-limiting examples of 2-input AND gates (AND gates based on 2 target antigens) are depicted schematically in FIG. 3A.

For example, in some cases, the first antigen-triggered polypeptide is a BTTS and activation of the BTTS by binding to the first antigen (present on a target cancer cell) induces expression of the second antigen-triggered polypeptide. The second antigen-triggered polypeptide binds to the second antigen of the target antigen pair, where the second antigen is expressed on the surface of the target cancer cell. As an example, in some cases, the first antigen-triggered polypeptide is a BTTS and the second antigen-triggered polypeptide is a single chain CAR. As another example, in some cases, the first antigen-triggered polypeptide is a BTTS and the second antigen-triggered polypeptide is a TCR. For example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the TCR or the single-chain CAR.

As another example, in some cases, the first antigen-triggered polypeptide is a BTTS and activation of the BTTS by binding to the first antigen (present on a target cancer cell) induces expression of the second antigen-triggered polypeptide, where the second antigen-triggered polypeptide is a heterodimeric ("two chain" or "split") CAR comprising a first polypeptide chain and a second polypeptide chain. The heterodimeric CAR binds to the second antigen of the target antigen pair, where the second antigen is expressed on the surface of the target cancer cell. For example, in some cases, the first antigen-triggered polypeptide is a BTTS and the second antigen-triggered polypeptide is a split CAR (e.g., an ON-switch CAR). In some cases, activation of the BTTS by binding to the first antigen (present on a target cancer cell) induces expression of only the first polypeptide chain of the heterodimeric CAR; expression of the second polypeptide chain of the heterodimeric CAR can be constitutive. For example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the first polypeptide chain of the heterodimeric CAR. In some cases, activation of the BTTS by binding to the first antigen (present on a target cancer cell) induces expression of only the second polypeptide chain of the heterodimeric CAR; expression of the first polypeptide chain of the heterodimeric CAR can be constitutive. Once the first polypeptide chain of the heterodimeric CAR is produced in the cell, it heterodimerizes with the second polypeptide chain of the heterodimeric CAR. As another example, in some cases, the BTTS comprises an intracellular domain comprising a transcriptional activator, and activation of the BTTS by binding to the first antigen (present on a target cancer cell) induces release of the transcriptional activator; the released transcriptional activator activates transcription of the second polypeptide chain of the heterodimeric CAR.

In some cases, a genetically modified cytotoxic immune cell of the present disclosure is genetically modified to express a first antigen-triggered polypeptide and a second antigen-triggered polypeptide that bind to antigens of a 2-input AND-NOT-gate target antigen pair. Non-limiting examples of 2-input AND-NOT gates (AND-NOT gates based on 2 target antigens) are depicted schematically in FIG. 3B.

As an example, in some cases, the first antigen-triggered polypeptide is a CAR, and the second antigen-triggered polypeptide is an iCAR. Binding of the iCAR to the second antigen (present on the surface of a non-cancerous cell, but not on the surface of a target cancer cell) of a target antigen pair inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is an iCAR. Binding of the iCAR to the second antigen (present on the surface of a non-cancerous cell, but not on the surface of a target cancer cell) of a target antigen pair blocks or reduces T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a BTTS comprising an intracellular domain that, when released upon activation of the BTTS by binding to the second target antigen, induces expression of an intracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a BTTS comprising an intracellular domain that, when released upon activation of the BTTS by binding to the second target antigen, induces expression of an intracellular inhibitor that inhibits T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a BTTS comprising an intracellular domain that, when released upon activation of the BTTS by binding to the second target antigen, induces expression of an extracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a BTTS comprising an intracellular domain that, when released upon activation of the BTTS by binding to the second target antigen, induces expression of an extracellular inhibitor that inhibits T-cell activation mediated by activation of the TCR upon binding to the first antigen (present on the surface of the target cancer cell and on the surface of the non-cancerous cell) of the target antigen pair.

Systems for Inhibiting Cancer Cells

The present disclosure provides a system for inhibiting or killing a target cancer cell. A system of the present disclosure comprises: a) a first antigen-triggered polypeptide that binds specifically to a first target antigen present on the target cancer cell, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide.

In some cases, the target cancer cell is an acute myeloid leukemia cell, an anaplastic lymphoma cell, an astrocytoma cell, a B-cell cancer cell, a bone tumor cell, a breast cancer cell, a colon cancer cell, a gastric cancer cell, a glioblastoma cell, a glioma cell, a hepatocellular carcinoma cell, a leiomyosarcoma cell, a liposarcoma cell, a lung cancer cell, a mantle cell lymphoma cell, a melanoma cell, a neuroblastoma cell, a non small cell lung cancer cell, an oligodendroglioma cell, an ovarian cancer cell, a pancreatic cancer cell, a pancreatic ductal carcinoma cell, a prostate cancer cell, a renal cancer cell, a renal cell carcinoma cell, a sarcoma cell, a soft tissue sarcoma cell, a stomach cancer cell, or the like.

In some cases, as noted above, a system of the present disclosure comprises: a) a first antigen-triggered polypeptide that binds specifically to a first target antigen present on a target cancer cell; and b) a second antigen-triggered polypeptide that binds specifically to a second target antigen. In these instances, the polypeptides per se are introduced into an immune cell (e.g., $CD8^+$ T cells and/or NK cells obtained from an individual). Methods of introducing polypeptides into a cell are known in the art; and any known method can be used. For example, in some cases, the first and the second antigen-triggered polypeptides comprise a protein transduction domain (PTD) at the N-terminus or the C-terminus of the polypeptides.

In some cases, as noted above, a system of the present disclosure comprises: a) a first nucleic acid comprising a nucleotide sequence encoding a first antigen-triggered polypeptide that binds specifically to a first target antigen present on a target cancer cell; and b) a second nucleic acid comprising a nucleotide sequence encoding a second antigen-triggered polypeptide that binds specifically to a second target antigen. In some cases, the first and the second antigen-triggered polypeptides are encoded by nucleotide sequences on separate nucleic acids. In other cases, the first and the second antigen-triggered polypeptides are encoded by nucleotide sequences present in the same nucleic acid. In some cases, the nucleic acid is a recombinant expression vector. In some cases, a system of the present disclosure comprises: a) a first recombinant expression vector comprising a nucleotide sequence encoding a first antigen-triggered polypeptide that binds specifically to a first target antigen present on a target cancer cell; and b) a second recombinant expression vector comprising a nucleotide sequence encoding a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. In some cases, a system of the present disclosure comprises a recombinant expression vector comprising nucleotide sequences encoding: a) a first antigen-triggered polypeptide that binds specifically to a first target antigen present on a target cancer cell; and b) a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter.

Suitable promoters include, but are not limited to; cytomegalovirus immediate early promoter; herpes simplex virus thymidine kinase promoter; early and late SV40 promoters; promoter present in long terminal repeats from a retrovirus; a metallothionein-I promoter; and various art-known promoters. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

In some instances, nucleic acids present in a system of the present disclosure include immune cell specific promoters that are expressed in one or more immune cell types, including but not limited to lymphocytes, hematopoietic stem cells and/or progeny thereof (i.e., immune cell progenitors), etc. Any convenient and appropriate promoter of an immune cell specific gene may find use in nucleic acids of the present disclosure. In some instances, an immune cell specific promoter of a nucleic acid present in a system of the present disclosure may be a T cell specific promoter. In some instances, an immune cell specific promoter of a nucleic acid present in a system of the present disclosure may be a light and/or heavy chain immunoglobulin gene promoter and may or may not include one or more related enhancer elements.

In some instances, an immune cell specific promoter of a nucleic acid present in a system of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9 γ (TRGV9) gene promoter, a V2 δ (TRDV2) gene promoter, and the like.

In some instances, an immune cell specific promoter present in a system of a nucleic acid of the present disclosure may be a viral promoter expressed in immune cells. As such, in some instances, viral promoters useful in nucleic acids present in a system of the present disclosure include viral promoters derived from immune cells viruses, including but not limited to, e.g., lentivirus promoters (e.g., HIV, SIV, FIV, EIAV, or Visna promoters) including e.g., LTR promoter, etc., Retroviridae promoters including, e.g., HTLV-I promoter, HTLV-II promoter, etc., and the like.

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) *Proc. Natl. Acad. Sci. USA* 90:7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

Expression vectors generally have convenient restriction sites located near the promoter sequence to provide for the insertion of nucleic acid sequences encoding heterologous proteins. A selectable marker operative in the expression host may be present. Suitable recombinant expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

Antigen Combinations

A system of the present disclosure targets antigen combinations, where the targeting provides for specific killing of a target cancer cell. A system of the present disclosure targets antigen combinations, where the targeting provides for inducing a specific immune response to a target cancer cell. A genetically modified immune cell of the present disclosure targets antigen combinations, where the targeting provides for specific killing of a target cancer cell. A genetically modified immune cell of the present disclosure targets antigen combinations, where the targeting provides for inducing a specific immune response to a target cancer cell.

Antigen combinations may also reduce off-target effects and/or increase specificity for a target cancer cell, where e.g., an antigen combination includes one or more AND NOT combinations. Examples of target antigen combinations, and corresponding exemplary but non-limiting cancer that may be targeted, are depicted in FIG. 1. Antigen combinations described herein are not limited to use in methods, cells and system having two different polypeptides and such combinations may also find use, in some instances, in polyspecific-immune inducing polypeptides. The following antigen combinations are exemplary, and not meant to be limiting.

Antigen combinations of interest include e.g., combinations of PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EPHA2, NRCAM and ERBB2, NRCAM and IL13RA2, CLDN15 and GPC3, MET and TPBG, CDH6 and CA9, CSF3R and CD70, CADM1 and CD70, HEG1 and MUC1, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, GPR1 and EGFR, KCNJ5 and EGFR, LIFR and FAP, PCDH9 and EGFR, SLC46A1 and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, FXYD3 and EPCAM, BAMBI and B4GALNT1, C11orf24 and KDR, GPR19 and ERBB2, ST3GAL5 and FAP, TNFSF9 and MET, ADAM29 and MET, ADAM29 and ROR1, KCNB1 and B4GALNT1, NTRK3 and B4GALNT1, NTRK3 and ERBB2, SCN4A and MET, SLC8A3 and B4GALNT1, SYT13 and B4GALNT1, TMEM150B and MET, TSPAN1 and ERBB2, DIABLO and B4GALNT1, DIABLO and DLL3, DIABLO and GPC3, DIABLO and MSLN, SCN3A and GPC3, ADAM12 and CD80, ADAM12 and CD86, IL2RA and EGFR, KISS1R and EGFR, ADCY4 and CD274, CADM3 and EGFR, CD101 and CD274, CD36 and CD274, CYP4F12 and EGFR, MAL and CD274, TMEM17 and GPC3, ITGB8 and FOLR1, KCNA6 and FOLR1, KCNK15 and FOLR1, PTH2R and FOLR1, RET and FOLR1, LRRTM1 and CDH10, GP2 and MSLN, GP2 and PSCA, KCNE4 and CLDN18, NOX4 and PSCA, PPAPDC1A and PSCA, TNFSF4 and CLDN18, TREM2 and PSCA, CLDN18 and MAL, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, AXL and PDGFRA, CD70 and ADRB2, CD99 and B4GALNT1, CDH11 and B4GALNT1, HTRA2 and B4GALNT1, ATP13A4 and ROR1, Clorf210 and ERBB2, Clorf210 and ROR1, CDH1 and ROR1, ITGB6 and ERBB2, LSR and ERBB2, SCNN1A and ERBB2, SLC26A9 and ROR1, SLC2A12 and ERBB2, SLC6A14 and ROR1, NRCAM and PROM1, NRCAM and TSPAN11, ALDH1A1 and IL3RA, HEG1 and IL3RA, TGFBR3 and IL3RA, WLS and IL3RA, WLS and PROM1, LSR and LRRC8E, CLDN2 and DLL4, CXCL9 and DLL4, F2RL2 and DLL4, MUC13 and DKK1, VSIG1 and DLL4, CRB1 and IGFLR1, CRB1 and PROM1, NLGN4X and PROM1, SLC1A3 and PROM1, AFP and ALCAM, AFP and CNNM3, AFP and ERBB3, AFP and LRRC8D, AFP and SLC38A6, SLC17A2 and CLEC4M, ADIPOR2 and MAGEA1, BCAP31 and MAGEA1, SLC5A6 and MAGEA1, HTR1E and MAGEA1, NPFFR1 and MAGEA1, PMEL and ATP1A2, PMEL and SCN3B, PMEL and STAB2, PMEL and TMEM100, LICAM and DIABLO, LICAM and NTRK2, CD80 and GPM6A, CD86 and CD33, CD36 and CD86, GPBAR1 and CD86, P2RX1 and CD86, SEZ6 and CD80, SLC13A4 and CD80, SLC6A4 and CD80, LRRTM1 and SLC28A3, LRRTM1 and VTCN1, PIRT and VTCN1, SSX1 and VTCN1, CLCNKB and SLC22A2, LRRTM1 and SCN4B, NOX4 and CEACAM6, ATP9A and NRP1, CDH7 and NRP1, TSPAN1 and NRP1, FOLH1 and SEMA5A, NRP1 and RAMP3, TRPM8 and EPHB1, CLDN2 and PCDHB10, ENPEP and ROR2, ENPP3 and ROR2, EPHA7 and SLCO4C1, MAGT1 and ROR2, SLC3A1 and ROR2, GPM6B and ROR2, SLC22A2 and KCNJ1, LINGO1 and NALCN, THY1 and NDRG4, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and IL13RA2, PTPRZ1 and EPHA2, PTPRZ1 and B4GALNT1, PTPRZ1 and ERBB2, BCAN and IL13RA2, BCAN and GPC3, BCAN and ROR1, BCAN and B4GALNT1, BCAN and ERBB2, MLC1 and IL13RA2, MLC1 and DLL3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and DLL3, AQP4 and EPHA2, AQP4 and GPC3, AQP4 and MSLN, AQP4 and ROR1, AQP4 and MUC1, or AQP4 and ERBB2, including where the combinations are configured according to the logic presented in FIG. 1.

In some instances, useful antigen combinations may be selected from: PTPRZ1 AND IL13RA2, FAP AND CLDN3, CA9 AND IL13RA2, PTPRZ1 AND DLL3, PTPRZ1 AND EPHA2, PTPRZ1 AND GPC3, PTPRZ1 AND MSLN, PTPRZ1 AND ROR1, CDH10 AND KDR, CDH10 AND ROR1, PTPRZ1 AND DLL3, FAP AND CD274, FCRL5 AND EGFR, MSLN AND FAP, FAP AND PSCA, CD70 AND CA9, CD70 AND FOLR1, BIRC5 AND B4GALNT1, PMEPA1 AND ERBB2, PMEPA1 AND MSLN, BCAN AND DLL3, BCAN AND EGFR, BCAN AND EGFR, BCAN AND EPHA2, BCAN AND MSLN, BCAN AND MUC1, MLC1 AND EPHA2, MLC1 AND GPC3, NLGN3 AND B4GALNT1, NLGN3 AND ERBB2, NRCAM AND EGFR, NRCAM AND EGFR, NRCAM AND EPHA2, NRCAM AND ERBB2, NRCAM AND IL13RA2, CLDN15 AND GPC3, MET AND NOT-TPBG, CDH6 AND CA9, CSF3R AND CD70, NOT-CADM1 AND CD70, NOT-HEG1 AND MUC1, CCR5 AND MET, CD84 AND MET, CXCL9 AND ERBB2, KCNK15 AND MSLN, LPAR2 AND MET, SLC38A1 AND MET, SLC5A6 AND ERBB2, SLC5A6 AND MSLN, TNFSF4 AND MET, AMIGO2 AND CEACAM5, BFAR AND EGFR, NOT-GPR1 AND EGFR, NOT-KCNJ5 AND EGFR, NOT-LIFR AND FAP, NOT-PCDH9 AND EGFR, NOT-SLC46A1 AND EGFR, PSCA AND DLL4, AQP4 AND B4GALNT1, AQP4 AND IL13RA2, B4GALNT1 AND ADAM17, BEST3 AND IL13RA2, CDH10 AND F2R, CDH10 AND MMP14, CRB1 AND EGFR, CRB1 AND EGFR, CRB1 AND EPHA2, GPM6A AND GPC3, GRIK5 AND ERBB2, ITGB8 AND IL13RA2, NLGN4X AND EGFR, NLGN4X AND EGFR, NRSN2 AND ERBB2, PDPN AND B4GALNT1, SEMA5B AND ERBB2, SLC6A1 AND MUC1, TTYH3 AND B4GALNT1, CDH10 AND MAGEA1, GPM6A AND ERBB2, GPM6A AND KDR, GPM6A AND ROR1, GPR19 AND KDR, GPR19 AND MSLN, GPR19 AND ROR1, NLGN1 AND DLL3, SLC1A3 AND MSLN, ABCC6 AND GPC3, ACSL6 AND EPCAM, C1QTNF1 AND EPCAM, GPR88 AND EPCAM, PAQR9 AND EPCAM, SLC2A2 AND GPC3, SLC30A10 AND GPC3, SLCO1B1 AND GPC3, NOT-FXYD3 AND EPCAM, BAMBI AND B4GALNT1, C11orf24 AND KDR, GPR19 AND ERBB2, ST3GAL5 AND FAP, TNFSF9 AND MET, NOT-ADAM29 AND MET, NOT-ADAM29 AND ROR1, NOT-CDH10 AND MAGEA1, NOT-KCNB1 AND B4GALNT1, NOT-NTRK3 AND B4GALNT1, NOT-NTRK3 AND ERBB2, NOT-SCN4A AND MET, NOT-SLC8A3 AND B4GALNT1, NOT-SYT13 AND B4GALNT1, NOT-TMEM150B AND MET, NOT-TSPAN1 AND ERBB2, DIABLO AND B4GALNT1, DIABLO AND DLL3, DIABLO AND GPC3, DIABLO AND MSLN, GPR19 AND KDR, SCN3A AND GPC3, ADAM12 AND CD80, ADAM12 AND CD86, IL2RA AND EGFR, KISS1R AND EGFR, NOT-ADCY4 AND CD274, NOT-CADM3 AND EGFR, NOT-CD101 AND CD274, NOT-CD36 AND CD274, NOT-CYP4F12 AND EGFR, NOT-MAL AND CD274, NOT-TMEM17 AND GPC3, ITGB8 AND FOLR1, KCNA6 AND FOLR1, KCNK15 AND FOLR1, PTH2R AND FOLR1, RET AND FOLR1, LRRTM1 AND NOT-CDH10, GP2 AND MSLN, GP2 AND PSCA, KCNE4 AND CLDN18, NOX4 AND PSCA, PPAPDC1A AND PSCA, TNFSF4 AND CLDN18, TREM2 AND PSCA, CLDN18 AND NOT-MAL, CDH10 AND NRP1, KCNJ16 AND AXL, LRP2 AND AXL, LRP2 AND CA9, SLC16A4 AND AXL, SLC3A1 AND AXL, SLC3A1 AND CA9, TMEM27 AND CA9, AXL AND NOT-PDGFRA, CD70 AND NOT-ADRB2, CD99 AND B4GALNT1, CDH11 AND B4GALNT1, HTRA2 AND B4GALNT1, NOT-ATP13A4 AND ROR1, NOT-Clorf210 AND ERBB2, NOT-Clorf210 AND ROR1, NOT-CDH1 AND ROR1, NOT-ITGB6 AND ERBB2, NOT-LSR AND ERBB2, NOT-SCNN1A AND ERBB2, NOT-SLC26A9 AND ROR1, NOT-SLC2A12 AND ERBB2, NOT-SLC6A14 AND ROR1, NRCAM AND PROM1, and NRCAM AND TSPAN11.

In some instances, useful antigen combinations may be selected from: PTPRZ1 AND IL13RA2, FAP AND CLDN3, CA9 AND IL13RA2, PTPRZ1 AND DLL3, PTPRZ1 AND EPHA2, PTPRZ1 AND GPC3, PTPRZ1 AND MSLN, PTPRZ1 AND ROR1, CDH10 AND KDR, CDH10 AND ROR1, PTPRZ1 AND DLL3, FAP AND CD274, FCRL5 AND EGFR, MSLN AND FAP, FAP AND PSCA, CD70 AND CA9, CD70 AND FOLR1, BIRC5 AND B4GALNT1, PMEPA1 AND ERBB2, PMEPA1 AND MSLN, BCAN AND DLL3, BCAN AND EGFR, BCAN AND EGFR, BCAN AND EPHA2, BCAN AND MSLN, BCAN AND MUC1, MLC1 AND EPHA2, MLC1 AND GPC3, NLGN3 AND B4GALNT1, NLGN3 AND ERBB2, NRCAM AND EGFR, NRCAM AND EGFR, NRCAM AND EPHA2, NRCAM AND ERBB2, NRCAM AND IL13RA2, CLDN15 AND GPC3, MET AND NOT-TPBG, and CDH6 AND CA9.

In some instances, useful antigen combinations may be selected from: PTPRZ1 AND IL13RA2, FAP AND CLDN3, CA9 AND IL13RA2, PTPRZ1 AND DLL3, PTPRZ1 AND EPHA2, PTPRZ1 AND GPC3, PTPRZ1 AND MSLN, PTPRZ1 AND ROR1, CDH10 AND KDR, CDH10 AND ROR1, PTPRZ1 AND DLL3, FAP AND CD274, FCRL5 AND EGFR, MSLN AND FAP, FAP AND PSCA, CD70 AND CA9, CD70 AND FOLR1, and BIRC5 AND B4GALNT1.

Breast Cancer Antigen Target Combinations

In some cases, an antigen combination for targeting a breast cancer cell comprises FAP AND CLDN3. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190. In some cases, the CLDN3 polypeptide comprises an amino acid sequence having at least 85%, at least 90%, at least 95%, at least 98%, at least 99%, or 100%, amino acid sequence identity to an amino acid sequence set forth in SEQ ID NO:137.

In some cases, an antigen combination for targeting a breast cancer cell comprises PMEPA1 AND ERBB2. In some cases, the PMEPA1 polypeptide comprises an amino acid sequence having at least 85%, at least 90%, at least 95%, at least 98%, at least 99%, or 100%, amino acid sequence identity to an amino acid sequence set forth in SEQ ID NO:411-415. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a breast cancer cell comprises PMEPA1 AND MSLN. In some cases, the PMEPA1 polypeptide comprises an amino acid sequence having at least 85%, at least 90%, at least 95%, at least 98%, at least 99%, or 100%, amino acid sequence identity to an amino acid sequence set forth in SEQ ID NO:411-415. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a breast cancer cell comprises CCR5 AND MET. In some cases, the CCR5 polypeptide comprises an amino acid sequence having at least 85%, at least 90%, at least 95%, at least 98%, at least 99%, or 100%, amino acid sequence identity to an amino acid sequence set forth in SEQ ID NO:77-78. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a breast cancer cell comprises CD84 AND MET. In some cases, the CD84 polypeptide comprises an amino acid sequence having at least 85%, at least 90%, at least 95%, at least 98%, at least 99%, or 100%, amino acid sequence identity to an amino acid sequence set forth in SEQ ID NO:98-102. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a breast cancer cell comprises CXCL9 AND ERBB2. In some cases, the CXCL9 polypeptide comprises an amino acid sequence having at least 85%, at least 90%, at least 95%, at least 98%, at least 99%, or 100%, amino acid sequence identity to an amino acid sequence set forth in SEQ ID NO:155. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a breast cancer cell comprises KCNK15 AND MSLN. In some cases, the KCNK15 polypeptide comprises an amino acid sequence having at least 85%, at least 90%, at least 95%, at least 98%, at least 99%, or 100%, amino acid sequence identity to an amino acid sequence set forth in SEQ ID NO:273. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a breast cancer cell comprises LPAR2 AND MET. In some cases, the LPAR2 polypeptide comprises an amino acid sequence having at least 85%, at least 90%, at least 95%, at least 98%, at least 99%, or 100%, amino acid sequence identity to an amino acid sequence set forth in SEQ ID NO:294. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a breast cancer cell comprises SLC38A1 AND MET. In some cases, the SLC38A1 polypeptide comprises an amino acid sequence having at least 85%, at least 90%, at least 95%, at least 98%, at least 99%, or 100%, amino acid sequence identity to an amino acid sequence set forth in SEQ ID NO:482-486. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a breast cancer cell comprises SLC5A6 AND ERBB2. In some cases, the SLC5A6 polypeptide comprises an amino acid sequence having at least 85%, at least 90%, at least 95%, at least 98%, at least 99%, or 100%, amino acid sequence identity to an amino acid sequence set forth in SEQ ID NO:492. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a breast cancer cell comprises SLC5A6 AND MSLN. In some cases, the SLC5A6 polypeptide comprises an amino acid sequence having at least 85%, at least 90%, at least 95%, at least 98%, at least 99%, or 100%, amino acid sequence identity to an amino acid sequence set forth in SEQ ID NO:492. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a breast cancer cell comprises TNFSF4 AND MET. In some cases, the TNFSF4 polypeptide comprises an amino acid sequence having at least 85%, at least 90%, at least 95%, at least 98%, at least 99%, or 100%, amino acid sequence identity to an amino acid sequence set forth in SEQ ID NO:523-524. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

Glioblastoma Antigen Target Combinations

In some instances, an antigen combination for targeting a glioblastoma cell may be selected from: PTPRZ1 and IL13RA2, CA9 and IL13RA2, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and DLL3, PTPRZ1 and EPHA2, PTPRZ1 and GPC3, PTPRZ1 and MSLN, PTPRZ1 and ROR1, PTPRZ1 and B4GALNT1, PTPRZ1 and ERBB2, BCAN and IL13RA2, BCAN and DLL3, BCAN and EPHA2, BCAN and GPC3, BCAN and MSLN, BCAN and ROR1, BCAN and EGFR, BCAN and MUC1, BCAN and B4GALNT1, BCAN and ERBB2, MLC1 and IL13RA2, MLC1 and DLL3, MLC1 and EPHA2, MLC1 and GPC3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NLGN3 and B4GALNT1, NLGN3 and ERBB2, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and IL13RA2, AQP4 and DLL3, AQP4 and EPHA2, AQP4 and GPC3, AQP4 and MSLN, AQP4 and ROR1, AQP4 and MUC1, AQP4 and B4GALNT1, AQP4 and ERBB2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, and CRB1 and IGFLR1.

In some instances, an antigen combination for targeting a glioblastoma cell may be selected from those antigen combinations presented in FIG. 17. For example, in some instances, useful antigen combinations, and the pair logic thereof, for targeting a glioblastoma cell may be an antigen combination selected from: DLL3 AND EGFR, DLL3 AND ERBB2, DLL3 AND NOT-GRM3, DLL3 AND MUC1, NRCAM AND DLL3, DLL3 AND NOT-ROR1, EGFR AND NOT-ERBB2, EGFR AND GRM3, EGFR AND IL13RA2, EGFR AND NOT-MUC1, EGFR AND NOT-ROR1, GRM3 AND ERBB2, BCAN AND ERBB2, GRM3 AND IL13RA2, GRM3 AND MUC1, NRCAM AND NOT-GRM3, GRM3 AND ROR1, BCAN AND NOT-GRM3, IL13RA2 AND MUC1, IL13RA2 AND ROR1, BCAN AND NRCAM, and BCAN AND PTPRZ1.

In some cases, an antigen combination for targeting a glioblastoma cell comprises CA9 AND IL13RA2. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises PTPRZ1 AND DLL3. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises PTPRZ1 AND EPHA2. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises PTPRZ1 AND GPC3. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises PTPRZ1 AND IL13RA2. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises PTPRZ1 AND MSLN. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises PTPRZ1 AND ROR1. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises BCAN AND DLL3. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises BCAN AND EPHA2. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises BCAN AND MSLN. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises BCAN AND MUC1. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises MLC1 AND EPHA2. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises MLC1 AND GPC3. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises NLGN3 AND B4GALNT1. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises NLGN3 AND ERBB2. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises NRCAM AND EPHA2. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises NRCAM AND ERBB2. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises NRCAM AND IL13RA2. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises AQP4 AND B4GALNT1. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises AQP4 AND IL13RA2. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises B4GALNT1 AND ADAM17. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42. In some cases, the ADAM17 polypeptide comprises an amino acid sequence having at least 85%, at least 90%, at least 95%, at least 98%, at least 99%, or 100%, amino acid sequence identity to an amino acid sequence set forth in SEQ ID NO:13.

In some cases, an antigen combination for targeting a glioblastoma cell comprises BEST3 AND IL13RA2. In some cases, the BEST3 polypeptide comprises an amino acid sequence having at least 85%, at least 90%, at least 95%, at least 98%, at least 99%, or 100%, amino acid sequence identity to an amino acid sequence set forth in SEQ ID NO:50-55. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises CDH10 AND F2R. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the F2R polypeptide comprises an amino acid sequence having at least 85%, at least 90%, at least 95%, at least 98%, at least 99%, or 100%, amino acid sequence identity to an amino acid sequence set forth in SEQ ID NO:185-186.

In some cases, an antigen combination for targeting a glioblastoma cell comprises CDH10 AND MMP14. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the MMP14 polypeptide comprises an amino acid sequence having at least 85%, at least 90%, at least 95%, at least 98%, at least 99%, or 100%, amino acid sequence identity to an amino acid sequence set forth in SEQ ID NO:317.

In some cases, an antigen combination for targeting a glioblastoma cell comprises CRB1 AND EPHA2. In some cases, the CRB1 polypeptide comprises an amino acid sequence having at least 85%, at least 90%, at least 95%, at least 98%, at least 99%, or 100%, amino acid sequence identity to an amino acid sequence set forth in SEQ ID NO:148-151. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises GPM6A AND GPC3. In some cases, the GPM6A polypeptide comprises an amino acid sequence having at least 85%, at least 90%, at least 95%, at least 98%, at least 99%, or 100%, amino acid sequence identity to an amino acid sequence set forth in SEQ ID NO:219-222. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises GRIK5 AND ERBB2. In some cases, the GRIK5 polypeptide comprises an amino acid sequence having at least 85%, at least 90%, at least 95%, at least 98%, at least 99%, or 100%, amino acid sequence identity to an amino acid sequence set forth in SEQ ID NO:235-236. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises ITGB8 AND IL13RA2. In some cases, the ITGB8 polypeptide comprises an amino acid sequence having at least 85%, at least 90%, at least 95%, at least 98%, at least 99%, or 100%, amino acid sequence identity to an amino acid sequence set forth in SEQ ID NO:255. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises NRSN2 AND ERBB2. In some cases, the NRSN2 polypeptide comprises an amino acid sequence having at least 85%, at least 90%, at least 95%, at least 98%, at least 99%, or 100%, amino acid sequence identity to an amino acid sequence set forth in SEQ ID NO:375-382. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises PDPN AND B4GALNT1. In some cases, the PDPN polypeptide comprises an amino acid sequence having at least 85%, at least 90%, at least 95%, at least 98%, at least 99%, or 100%, amino acid sequence identity to an amino acid sequence set forth in SEQ ID NO:401-404. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises SEMA5B AND ERBB2. In some cases, the SEMA5B polypeptide comprises an amino acid sequence having at least 85%, at least 90%, at least 95%, at least 98%, at least 99%, or 100%, amino acid sequence identity to an amino acid sequence set forth in SEQ ID NO:453-455. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises SLC6A1 AND MUC1. In some cases, the SLC6A1 polypeptide comprises an amino acid sequence having at least 85%, at least 90%, at least 95%, at least 98%, at least 99%, or 100%, amino acid sequence identity to an amino acid sequence set forth in SEQ ID NO:493-494. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises TTYH3 AND B4GALNT1. In some cases, the TTYH3 polypeptide comprises an amino acid sequence having at least 85%, at least 90%, at least 95%, at least 98%, at least 99%, or 100%, amino acid sequence identity to an amino acid sequence set forth in SEQ ID NO:533. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises CRB1 AND IGFLR1. In some cases, the CRB1 polypeptide comprises an amino acid sequence having at least 85%, at least 90%, at least 95%, at least 98%, at least 99%, or 100%, amino acid sequence identity to an amino acid sequence set forth in SEQ ID NO:148-151. In some cases, the IGFLR1 polypeptide comprises an amino acid sequence having at least 85%, at least 90%, at least 95%, at least 98%, at least 99%, or 100%, amino acid sequence identity to an amino acid sequence set forth in SEQ ID NO:242-244.

In some cases, an antigen combination for targeting a glioblastoma cell comprises CA9 AND DLL3. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises CA9 AND EPHA2. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises CA9 AND GPC3. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises CA9 AND MSLN. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises CA9 AND ROR1. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises CA9 AND EGFR. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a glioblastoma cell comprises CA9 AND MUC1. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises CA9 AND B4GALNT1. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises CA9 AND ERBB2. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises PTPRZ1 AND B4GALNT1. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises PTPRZ1 AND ERBB2. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises BCAN AND IL13RA2. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises BCAN AND GPC3. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises BCAN AND ROR1. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises BCAN AND B4GALNT1. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises BCAN AND ERBB2. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises MLC1 AND IL13RA2. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises MLC1 AND DLL3. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises MLC1 AND MSLN. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises MLC1 AND ROR1. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises MLC1 AND MUC1. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises MLC1 AND B4GALNT1. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises MLC1 AND ERBB2. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioblastoma cell comprises NLGN3 AND IL13RA2. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the IL13RA2 polypeptide comprises an amino acid sequence having at least 85%, at least 90%, at least 95%, at least 98%, at least 99%, or 100%, amino acid sequence identity to an amino acid sequence set forth in SEQ ID NO:245.

In some cases, an antigen combination for targeting a glioblastoma cell comprises NLGN3 AND DLL3. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises NLGN3 AND EPHA2. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises NLGN3 AND GPC3. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises NLGN3 AND MSLN. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises NLGN3 AND ROR1. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises NLGN3 AND EGFR. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a glioblastoma cell comprises NLGN3 AND MUC1. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises NRCAM AND DLL3. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises NRCAM AND GPC3. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises NRCAM AND MSLN. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises NRCAM AND ROR1. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises NRCAM AND B4GALNT1. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a glioblastoma cell comprises CA9 AND BCAN. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45.

In some cases, an antigen combination for targeting a glioblastoma cell comprises CA9 AND MLC1. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316.

In some cases, an antigen combination for targeting a glioblastoma cell comprises CA9 AND NLGN3. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354.

In some cases, an antigen combination for targeting a glioblastoma cell comprises CA9 AND NRCAM. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370.

In some cases, an antigen combination for targeting a glioblastoma cell comprises PTPRZ1 AND BCAN. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45.

In some cases, an antigen combination for targeting a glioblastoma cell comprises PTPRZ1 AND NLGN3. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354.

In some cases, an antigen combination for targeting a glioblastoma cell comprises BCAN AND MLC1. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316.

In some cases, an antigen combination for targeting a glioblastoma cell comprises BCAN AND NLGN3. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354.

In some cases, an antigen combination for targeting a glioblastoma cell comprises BCAN AND NRCAM. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370.

In some cases, an antigen combination for targeting a glioblastoma cell comprises MLC1 AND NLGN3. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354.

In some cases, an antigen combination for targeting a glioblastoma cell comprises MLC1 AND NRCAM. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370.

In some cases, an antigen combination for targeting a glioblastoma cell comprises NLGN3 AND NRCAM. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370.

In some cases, an antigen combination for targeting a glioblastoma cell comprises AQP4 AND CA9. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a glioblastoma cell comprises AQP4 AND BCAN. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the BCAN polypeptide comprises an amino acid sequence having at least 85%, at least 90%, at least 95%, at least 98%, at least 99%, or 100%, amino acid sequence identity to an amino acid sequence set forth in SEQ ID NO:44-45.

In some cases, an antigen combination for targeting a glioblastoma cell comprises AQP4 AND MLC1. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the MLC1 polypeptide comprises an amino acid sequence having at least 85%, at least 90%, at least 95%, at least 98%, at least 99%, or 100%, amino acid sequence identity to an amino acid sequence set forth in SEQ ID NO:315-316.

In some cases, an antigen combination for targeting a glioblastoma cell comprises AQP4 AND NLGN3. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the NLGN3 polypeptide comprises an amino acid sequence having at least 85%, at least 90%, at least 95%, at least 98%, at least 99%, or 100%, amino acid sequence identity to an amino acid sequence set forth in SEQ ID NO:351-354.

In some cases, an antigen combination for targeting a glioblastoma cell comprises AQP4 AND NRCAM. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370.

In some cases, an antigen combination for targeting a glioblastoma cell comprises AQP4 AND DLL3. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioblastoma cell comprises AQP4 AND EPHA2. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the EPHA2 polypeptide comprises an amino acid sequence having at least 85%, at least 90%, at least 95%, at least 98%, at least 99%, or 100%, amino acid sequence identity to an amino acid sequence set forth in SEQ ID NO:174.

In some cases, an antigen combination for targeting a glioblastoma cell comprises AQP4 AND GPC3. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a glioblastoma cell comprises AQP4 AND MSLN. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioblastoma cell comprises AQP4 AND ROR1. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioblastoma cell comprises AQP4 AND MUC1. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a glioblastoma cell comprises AQP4 AND ERBB2. In some cases, the AQP4 polypeptide comprises an amino acid sequence having at least 85%, at least 90%, at least 95%, at least 98%, at least 99%, or 100%, amino acid sequence identity to an amino acid sequence set forth in SEQ ID NO:33-34. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

Glioma Target Antigen Combinations

In some cases, an antigen combination for targeting a glioma cell comprises CDH10 AND KDR. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the KDR polypeptide comprises an amino acid sequence having at least 85%, at least 90%, at least 95%, at least 98%, at least 99%, or 100%, amino acid sequence identity to an amino acid sequence set forth in SEQ ID NO:274.

In some cases, an antigen combination for targeting a glioma cell comprises CDH10 AND ROR1. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioma cell comprises PTPRZ1 AND DLL3. In some cases, the PTPRZ1 polypeptide comprises an amino acid sequence having at least 85%, at least 90%, at least 95%, at least 98%, at least 99%, or 100%, amino acid sequence identity to an amino acid sequence set forth in SEQ ID NO:430-432. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioma cell comprises CDH10 AND MAGEA1. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a glioma cell comprises GPM6A AND ERBB2. In some cases, the GPM6A polypeptide comprises an amino acid sequence having at least 85%, at least 90%, at least 95%, at least 98%, at least 99%, or 100%, amino acid sequence identity to an amino acid sequence set forth in SEQ ID NO:219-222. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a glioma cell comprises GPM6A AND KDR. In some cases, the GPM6A polypeptide comprises an amino acid sequence having at least 85%, at least 90%, at least 95%, at least 98%, at least 99%, or 100%, amino acid sequence identity to an amino acid sequence set forth in SEQ ID NO:219-222. In some cases, the KDR polypeptide comprises an amino acid sequence having at least 85%, at least 90%, at least 95%, at least 98%, at least 99%, or 100%, amino acid sequence identity to an amino acid sequence set forth in SEQ ID NO:274.

In some cases, an antigen combination for targeting a glioma cell comprises GPM6A AND ROR1. In some cases, the GPM6A polypeptide comprises an amino acid sequence having at least 85%, at least 90%, at least 95%, at least 98%, at least 99%, or 100%, amino acid sequence identity to an amino acid sequence set forth in SEQ ID NO:219-222. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioma cell comprises GPR19 AND KDR. In some cases, the GPR19 polypeptide comprises an amino acid sequence having at least 85%, at least 90%, at least 95%, at least 98%, at least 99%, or 100%, amino acid sequence identity to an amino acid sequence set forth in SEQ ID NO:233. In some cases, the KDR polypeptide comprises an amino acid sequence having at least 85%, at least 90%, at least 95%, at least 98%, at least 99%, or 100%, amino acid sequence identity to an amino acid sequence set forth in SEQ ID NO:274.

In some cases, an antigen combination for targeting a glioma cell comprises GPR19 AND MSLN. In some cases, the GPR19 polypeptide comprises an amino acid sequence having at least 85%, at least 90%, at least 95%, at least 98%, at least 99%, or 100%, amino acid sequence identity to an amino acid sequence set forth in SEQ ID NO:233. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioma cell comprises GPR19 AND ROR1. In some cases, the GPR19 polypeptide comprises an amino acid sequence having at least 85%, at least 90%, at least 95%, at least 98%, at least 99%, or 100%, amino acid sequence identity to an amino acid sequence set forth in SEQ ID NO:233. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a glioma cell comprises NLGN1 AND DLL3. In some cases, the NLGN1 polypeptide comprises an amino acid sequence having at least 85%, at least 90%, at least 95%, at least 98%, at least 99%, or 100%, amino acid sequence identity to an amino acid sequence set forth in SEQ ID NO:350. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a glioma cell comprises SLC1A3 AND MSLN. In some cases, the SLC1A3 polypeptide comprises an amino acid sequence having at least 85%, at least 90%, at least 95%, at least 98%, at least 99%, or 100%, amino acid sequence identity to an amino acid sequence set forth in SEQ ID NO:469-471. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a glioma cell comprises NRCAM AND PROM1. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the PROM1 polypeptide comprises an amino acid sequence having at least 85%, at least 90%, at least 95%, at least 98%, at least 99%, or 100%, amino acid sequence identity to an amino acid sequence set forth in SEQ ID NO:421-427.

In some cases, an antigen combination for targeting a glioma cell comprises NRCAM AND TSPAN11. In some cases, the NRCAM polypeptide comprises an amino acid sequence having at least 85%, at least 90%, at least 95%, at least 98%, at least 99%, or 100%, amino acid sequence identity to an amino acid sequence set forth in SEQ ID NO:366-370. In some cases, the TSPAN11 polypeptide comprises an amino acid sequence having at least 85%, at least 90%, at least 95%, at least 98%, at least 99%, or 100%, amino acid sequence identity to an amino acid sequence set forth in SEQ ID NO:532.

In some cases, an antigen combination for targeting a glioma cell comprises CRB1 AND PROM1. In some cases, the CRB1 polypeptide comprises an amino acid sequence having at least 85%, at least 90%, at least 95%, at least 98%, at least 99%, or 100%, amino acid sequence identity to an amino acid sequence set forth in SEQ ID NO:148-151. In some cases, the PROM1 polypeptide comprises an amino acid sequence having at least 85%, at least 90%, at least 95%, at least 98%, at least 99%, or 100%, amino acid sequence identity to an amino acid sequence set forth in SEQ ID NO:421-427.

In some cases, an antigen combination for targeting a glioma cell comprises NLGN4X AND PROM1. In some cases, the NLGN4X polypeptide comprises an amino acid sequence having at least 85%, at least 90%, at least 95%, at least 98%, at least 99%, or 100%, amino acid sequence identity to an amino acid sequence set forth in SEQ ID NO:355-358. In some cases, the PROM1 polypeptide comprises an amino acid sequence having at least 85%, at least 90%, at least 95%, at least 98%, at least 99%, or 100%, amino acid sequence identity to an amino acid sequence set forth in SEQ ID NO:421-427.

In some cases, an antigen combination for targeting a glioma cell comprises SLC1A3 AND PROM1. In some cases, the SLC1A3 polypeptide comprises an amino acid sequence having at least 85%, at least 90%, at least 95%, at least 98%, at least 99%, or 100%, amino acid sequence identity to an amino acid sequence set forth in SEQ ID NO:469-471. In some cases, the PROM1 polypeptide comprises an amino acid sequence having at least 85%, at least 90%, at least 95%, at least 98%, at least 99%, or 100%, amino acid sequence identity to an amino acid sequence set forth in SEQ ID NO:421-427.

Non Small Cell Lung Cancer (NSCLC) Target Antigen Combinations

In some cases, an antigen combination for targeting a non small cell lung cancer cell comprises FAP AND CD274. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190. In some cases, the CD274 polypeptide comprises an amino acid sequence having at least 85%, at least 90%, at least 95%, at least 98%, at least 99%, or 100%, amino acid sequence identity to an amino acid sequence set forth in SEQ ID NO:82-83.

In some cases, an antigen combination for targeting a non small cell lung cancer cell comprises FCRL5 AND EGFR. In some cases, the FCRL5 polypeptide comprises an amino acid sequence having at least 85%, at least 90%, at least 95%, at least 98%, at least 99%, or 100%, amino acid sequence identity to an amino acid sequence set forth in SEQ ID NO:191-192. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a non small cell lung cancer cell comprises ADAM12 AND CD80. In some cases, the ADAM12 polypeptide comprises an amino acid sequence having at least 85%, at least 90%, at least 95%, at least 98%, at least 99%, or 100%, amino acid sequence identity to an amino acid sequence set forth in SEQ ID NO:9-12. In some cases, the CD80 polypeptide comprises an amino acid sequence having at least 85%, at least 90%, at least 95%, at least 98%, at least 99%, or 100%, amino acid sequence identity to an amino acid sequence set forth in SEQ ID NO:97.

In some cases, an antigen combination for targeting a non small cell lung cancer cell comprises ADAM12 AND CD86. In some cases, the ADAM12 polypeptide comprises an amino acid sequence having at least 85%, at least 90%, at least 95%, at least 98%, at least 99%, or 100%, amino acid sequence identity to an amino acid sequence set forth in SEQ ID NO:9-12. In some cases, the CD86 polypeptide comprises an amino acid sequence having at least 85%, at least 90%, at least 95%, at least 98%, at least 99%, or 100%, amino acid sequence identity to an amino acid sequence set forth in SEQ ID NO:103-107.

In some cases, an antigen combination for targeting a non small cell lung cancer cell comprises IL2RA AND EGFR. In some cases, the IL2RA polypeptide comprises an amino acid sequence having at least 85%, at least 90%, at least 95%, at least 98%, at least 99%, or 100%, amino acid sequence identity to an amino acid sequence set forth in SEQ ID NO:246-248. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a non small cell lung cancer cell comprises KISS1R AND EGFR. In some cases, the KISS1R polypeptide comprises an amino acid sequence having at least 85%, at least 90%, at least 95%, at least 98%, at least 99%, or 100%, amino acid sequence identity to an amino acid sequence set forth in SEQ ID NO:275. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a non small cell lung cancer cell comprises NOT-ADCY4 AND CD274. In some cases, the ADCY4 polypeptide comprises an amino acid sequence having at least 85%, at least 90%, at least 95%, at least 98%, at least 99%, or 100%, amino acid sequence identity to an amino acid sequence set forth in SEQ ID NO:21-23. In some cases, the CD274 polypeptide comprises an amino acid sequence having at least 85%, at least 90%, at least 95%, at least 98%, at least 99%, or 100%, amino acid sequence identity to an amino acid sequence set forth in SEQ ID NO:82-83.

In some cases, an antigen combination for targeting a non small cell lung cancer cell comprises NOT-CADM3 AND EGFR. In some cases, the CADM3 polypeptide comprises an amino acid sequence having at least 85%, at least 90%, at least 95%, at least 98%, at least 99%, or 100%, amino acid sequence identity to an amino acid sequence set forth in SEQ ID NO:74-76. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a non small cell lung cancer cell comprises NOT-CD101 AND CD274. In some cases, the CD101 polypeptide comprises an amino acid sequence having at least 85%, at least 90%, at least 95%, at least 98%, at least 99%, or 100%, amino acid sequence identity to an amino acid sequence set forth in SEQ ID NO:79-81. In some cases, the CD274 polypeptide comprises an amino acid sequence having at least 85%, at least 90%, at least 95%, at least 98%, at least 99%, or 100%, amino acid sequence identity to an amino acid sequence set forth in SEQ ID NO:82-83.

In some cases, an antigen combination for targeting a non small cell lung cancer cell comprises NOT-CD36 AND CD274. In some cases, the CD36 polypeptide comprises an amino acid sequence having at least 85%, at least 90%, at least 95%, at least 98%, at least 99%, or 100%, amino acid sequence identity to an amino acid sequence set forth in SEQ ID NO:87-94. In some cases, the CD274 polypeptide comprises an amino acid sequence having at least 85%, at least 90%, at least 95%, at least 98%, at least 99%, or 100%, amino acid sequence identity to an amino acid sequence set forth in SEQ ID NO:82-83.

In some cases, an antigen combination for targeting a non small cell lung cancer cell comprises NOT-CYP4F12 AND EGFR. In some cases, the CYP4F12 polypeptide comprises an amino acid sequence having at least 85%, at least 90%, at least 95%, at least 98%, at least 99%, or 100%, amino acid sequence identity to an amino acid sequence set forth in SEQ ID NO:156. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a non small cell lung cancer cell comprises NOT-MAL AND CD274. In some cases, the MAL polypeptide comprises an amino acid sequence having at least 85%, at least 90%, at least 95%, at least 98%, at least 99%, or 100%, amino acid sequence identity to an amino acid sequence set forth in SEQ ID NO:309-312. In some cases, the CD274 polypeptide comprises an amino acid sequence having at least 85%, at least 90%, at least 95%, at least 98%, at least 99%, or 100%, amino acid sequence identity to an amino acid sequence set forth in SEQ ID NO:82-83.

In some cases, an antigen combination for targeting a non small cell lung cancer cell comprises NOT-TMEM17 AND GPC3. In some cases, the TMEM17 polypeptide comprises an amino acid sequence having at least 85%, at least 90%, at least 95%, at least 98%, at least 99%, or 100%, amino acid sequence identity to an amino acid sequence set forth in SEQ ID NO:521. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a non small cell lung cancer cell comprises CD80 AND NOT-GPM6A. In some cases, the CD80 polypeptide comprises an amino acid sequence having at least 85%, at least 90%, at least 95%, at least 98%, at least 99%, or 100%, amino acid sequence identity to an amino acid sequence set forth in SEQ ID NO:97. In some cases, the GPM6A polypeptide comprises an amino acid sequence having at least 85%, at least 90%, at least 95%, at least 98%, at least 99%, or 100%, amino acid sequence identity to an amino acid sequence set forth in SEQ ID NO:219-222.

In some cases, an antigen combination for targeting a non small cell lung cancer cell comprises CD86 AND NOT-CD33. In some cases, the CD86 polypeptide comprises an amino acid sequence having at least 85%, at least 90%, at least 95%, at least 98%, at least 99%, or 100%, amino acid sequence identity to an amino acid sequence set forth in SEQ ID NO:103-107. In some cases, the CD33 polypeptide comprises an amino acid sequence having at least 85%, at least 90%, at least 95%, at least 98%, at least 99%, or 100%, amino acid sequence identity to an amino acid sequence set forth in SEQ ID NO:84-86.

In some cases, an antigen combination for targeting a non small cell lung cancer cell comprises NOT-CD36 AND CD86. In some cases, the CD36 polypeptide comprises an amino acid sequence having at least 85%, at least 90%, at least 95%, at least 98%, at least 99%, or 100%, amino acid sequence identity to an amino acid sequence set forth in SEQ ID NO:87-94. In some cases, the CD86 polypeptide comprises an amino acid sequence having at least 85%, at least 90%, at least 95%, at least 98%, at least 99%, or 100%, amino acid sequence identity to an amino acid sequence set forth in SEQ ID NO:103-107.

In some cases, an antigen combination for targeting a non small cell lung cancer cell comprises NOT-GPBAR1 AND CD86. In some cases, the GPBAR1 polypeptide comprises an amino acid sequence having at least 85%, at least 90%, at least 95%, at least 98%, at least 99%, or 100%, amino acid sequence identity to an amino acid sequence set forth in SEQ ID NO:212. In some cases, the CD86 polypeptide comprises an amino acid sequence having at least 85%, at least 90%, at least 95%, at least 98%, at least 99%, or 100%, amino acid sequence identity to an amino acid sequence set forth in SEQ ID NO:103-107.

In some cases, an antigen combination for targeting a non small cell lung cancer cell comprises NOT-P2RX1 AND CD86. In some cases, the P2RX1 polypeptide comprises an amino acid sequence having at least 85%, at least 90%, at least 95%, at least 98%, at least 99%, or 100%, amino acid sequence identity to an amino acid sequence set forth in SEQ ID NO:392. In some cases, the CD86 polypeptide comprises an amino acid sequence having at least 85%, at least 90%, at least 95%, at least 98%, at least 99%, or 100%, amino acid sequence identity to an amino acid sequence set forth in SEQ ID NO:103-107.

In some cases, an antigen combination for targeting a non small cell lung cancer cell comprises NOT-SEZ6 AND CD80. In some cases, the SEZ6 polypeptide comprises an amino acid sequence having at least 85%, at least 90%, at least 95%, at least 98%, at least 99%, or 100%, amino acid sequence identity to an amino acid sequence set forth in SEQ ID NO:456-458. In some cases, the CD80 polypeptide comprises an amino acid sequence having at least 85%, at least 90%, at least 95%, at least 98%, at least 99%, or 100%, amino acid sequence identity to an amino acid sequence set forth in SEQ ID NO:97.

In some cases, an antigen combination for targeting a non small cell lung cancer cell comprises NOT-SLC13A4 AND CD80. In some cases, the SLC13A4 polypeptide comprises an amino acid sequence having at least 85%, at least 90%, at least 95%, at least 98%, at least 99%, or 100%, amino acid sequence identity to an amino acid sequence set forth in SEQ ID NO:459-460. In some cases, the CD80 polypeptide comprises an amino acid sequence having at least 85%, at least 90%, at least 95%, at least 98%, at least 99%, or 100%, amino acid sequence identity to an amino acid sequence set forth in SEQ ID NO:97.

In some cases, an antigen combination for targeting a non small cell lung cancer cell comprises NOT-SLC6A4 AND CD80. In some cases, the SLC6A4 polypeptide comprises an amino acid sequence having at least 85%, at least 90%, at least 95%, at least 98%, at least 99%, or 100%, amino acid sequence identity to an amino acid sequence set forth in SEQ ID NO:496. In some cases, the CD80 polypeptide comprises an amino acid sequence having at least 85%, at least 90%, at least 95%, at least 98%, at least 99%, or 100%, amino acid sequence identity to an amino acid sequence set forth in SEQ ID NO:97.

Ovarian Cancer Target Antigen Combinations

In some cases, an antigen combination for targeting a ovarian cancer cell comprises MSLN AND FAP. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190.

In some cases, an antigen combination for targeting a ovarian cancer cell comprises ITGB8 AND FOLR1. In some cases, the ITGB8 polypeptide comprises an amino acid sequence having at least 85%, at least 90%, at least 95%, at least 98%, at least 99%, or 100%, amino acid sequence identity to an amino acid sequence set forth in SEQ ID NO:255. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a ovarian cancer cell comprises KCNA6 AND FOLR1. In some cases, the KCNA6 polypeptide comprises an amino acid sequence having at least 85%, at least 90%, at least 95%, at least 98%, at least 99%, or 100%, amino acid sequence identity to an amino acid sequence set forth in SEQ ID NO:256. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a ovarian cancer cell comprises KCNK15 AND FOLR1. In some cases, the KCNK15 polypeptide comprises an amino acid sequence having at least 85%, at least 90%, at least 95%, at least 98%, at least 99%, or 100%, amino acid sequence identity to an amino acid sequence set forth in SEQ ID NO:273. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a ovarian cancer cell comprises PTH2R AND FOLR1. In some cases, the PTH2R polypeptide comprises an amino acid sequence having at least 85%, at least 90%, at least 95%, at least 98%, at least 99%, or 100%, amino acid sequence identity to an amino acid sequence set forth in SEQ ID NO:428-429. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a ovarian cancer cell comprises RET AND FOLR1. In some cases, the RET polypeptide comprises an amino acid sequence having at least 85%, at least 90%, at least 95%, at least 98%, at least 99%, or 100%, amino acid sequence identity to an amino acid sequence set forth in SEQ ID NO:434-435. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a ovarian cancer cell comprises LRRTM1 AND NOT-CDH10. In some cases, the LRRTM1 polypeptide comprises an amino acid sequence having at least 85%, at least 90%, at least 95%, at least 98%, at least 99%, or 100%, amino acid sequence identity to an amino acid sequence set forth in SEQ ID NO:301. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117.

In some cases, an antigen combination for targeting a ovarian cancer cell comprises LRRTM1 AND SLC28A3. In some cases, the LRRTM1 polypeptide comprises an amino acid sequence having at least 85%, at least 90%, at least 95%, at least 98%, at least 99%, or 100%, amino acid sequence identity to an amino acid sequence set forth in SEQ ID NO:301. In some cases, the SLC28A3 polypeptide comprises an amino acid sequence having at least 85%, at least 90%, at least 95%, at least 98%, at least 99%, or 100%, amino acid sequence identity to an amino acid sequence set forth in SEQ ID NO:475-476.

In some cases, an antigen combination for targeting a ovarian cancer cell comprises LRRTM1 AND VTCN1. In some cases, the LRRTM1 polypeptide comprises an amino acid sequence having at least 85%, at least 90%, at least 95%, at least 98%, at least 99%, or 100%, amino acid sequence identity to an amino acid sequence set forth in SEQ ID NO:301. In some cases, the VTCN1 polypeptide comprises an amino acid sequence having at least 85%, at least 90%, at least 95%, at least 98%, at least 99%, or 100%, amino acid sequence identity to an amino acid sequence set forth in SEQ ID NO:536-538.

In some cases, an antigen combination for targeting a ovarian cancer cell comprises PIRT AND VTCN1. In some cases, the PIRT polypeptide comprises an amino acid sequence having at least 85%, at least 90%, at least 95%, at least 98%, at least 99%, or 100%, amino acid sequence identity to an amino acid sequence set forth in SEQ ID NO:405. In some cases, the VTCN1 polypeptide comprises an amino acid sequence having at least 85%, at least 90%, at least 95%, at least 98%, at least 99%, or 100%, amino acid sequence identity to an amino acid sequence set forth in SEQ ID NO:536-538.

In some cases, an antigen combination for targeting a ovarian cancer cell comprises SSX1 AND VTCN1. In some cases, the SSX1 polypeptide comprises an amino acid sequence having at least 85%, at least 90%, at least 95%, at least 98%, at least 99%, or 100%, amino acid sequence identity to an amino acid sequence set forth in SEQ ID NO:505-506. In some cases, the VTCN1 polypeptide comprises an amino acid sequence having at least 85%, at least 90%, at least 95%, at least 98%, at least 99%, or 100%, amino acid sequence identity to an amino acid sequence set forth in SEQ ID NO:536-538.

In some cases, an antigen combination for targeting a ovarian cancer cell comprises CLCNKB AND NOT-SLC22A2. In some cases, the CLCNKB polypeptide comprises an amino acid sequence having at least 85%, at least 90%, at least 95%, at least 98%, at least 99%, or 100%, amino acid sequence identity to an amino acid sequence set forth in SEQ ID NO:128-129. In some cases, the SLC22A2 polypeptide comprises an amino acid sequence having at least 85%, at least 90%, at least 95%, at least 98%, at least 99%, or 100%, amino acid sequence identity to an amino acid sequence set forth in SEQ ID NO:472.

In some cases, an antigen combination for targeting a ovarian cancer cell comprises LRRTM1 AND NOT-SCN4B. In some cases, the LRRTM1 polypeptide comprises an amino acid sequence having at least 85%, at least 90%, at least 95%, at least 98%, at least 99%, or 100%, amino acid sequence identity to an amino acid sequence set forth in SEQ ID NO:301. In some cases, the SCN4B polypeptide comprises an amino acid sequence having at least 85%, at least 90%, at least 95%, at least 98%, at least 99%, or 100%, amino acid sequence identity to an amino acid sequence set forth in SEQ ID NO:446-448.

Pancreatic Ductal Carcinoma Target Antigen Combinations

In some cases, an antigen combination for targeting a pancreatic ductal carcinoma cell comprises FAP AND PSCA. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543.

In some cases, an antigen combination for targeting a pancreatic ductal carcinoma cell comprises GP2 AND MSLN. In some cases, the GP2 polypeptide comprises an amino acid sequence having at least 85%, at least 90%, at least 95%, at least 98%, at least 99%, or 100%, amino acid sequence identity to an amino acid sequence set forth in SEQ ID NO:210-211. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a pancreatic ductal carcinoma cell comprises GP2 AND PSCA. In some cases, the GP2 polypeptide comprises an amino acid sequence having at least 85%, at least 90%, at least 95%, at least 98%, at least 99%, or 100%, amino acid sequence identity to an amino acid sequence set forth in SEQ ID NO:210-211. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543.

In some cases, an antigen combination for targeting a pancreatic ductal carcinoma cell comprises KCNE4 AND CLDN18. In some cases, the KCNE4 polypeptide comprises an amino acid sequence having at least 85%, at least 90%, at least 95%, at least 98%, at least 99%, or 100%, amino acid sequence identity to an amino acid sequence set forth in SEQ ID NO:258. In some cases, the CLDN18 polypeptide comprises an amino acid sequence having at least 85%, at least 90%, at least 95%, at least 98%, at least 99%, or 100%, amino acid sequence identity to an amino acid sequence set forth in SEQ ID NO:132-133.

In some cases, an antigen combination for targeting a pancreatic ductal carcinoma cell comprises NOX4 AND PSCA. In some cases, the NOX4 polypeptide comprises an amino acid sequence having at least 85%, at least 90%, at least 95%, at least 98%, at least 99%, or 100%, amino acid sequence identity to an amino acid sequence set forth in SEQ ID NO:359-364. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543.

In some cases, an antigen combination for targeting a pancreatic ductal carcinoma cell comprises PPAPDC1A AND PSCA. In some cases, the PPAPDC1A polypeptide comprises an amino acid sequence having at least 85%, at least 90%, at least 95%, at least 98%, at least 99%, or 100%, amino acid sequence identity to an amino acid sequence set forth in SEQ ID NO:416-420. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543.

In some cases, an antigen combination for targeting a pancreatic ductal carcinoma cell comprises TNFSF4 AND CLDN18. In some cases, the TNFSF4 polypeptide comprises an amino acid sequence having at least 85%, at least 90%, at least 95%, at least 98%, at least 99%, or 100%, amino acid sequence identity to an amino acid sequence set forth in SEQ ID NO:523-524. In some cases, the CLDN18 polypeptide comprises an amino acid sequence having at least 85%, at least 90%, at least 95%, at least 98%, at least 99%, or 100%, amino acid sequence identity to an amino acid sequence set forth in SEQ ID NO:132-133.

In some cases, an antigen combination for targeting a pancreatic ductal carcinoma cell comprises TREM2 AND PSCA. In some cases, the TREM2 polypeptide comprises an amino acid sequence having at least 85%, at least 90%, at least 95%, at least 98%, at least 99%, or 100%, amino acid sequence identity to an amino acid sequence set forth in SEQ ID NO:528-529. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543.

In some cases, an antigen combination for targeting a pancreatic ductal carcinoma cell comprises CLDN18 AND NOT-MAL. In some cases, the CLDN18 polypeptide comprises an amino acid sequence having at least 85%, at least 90%, at least 95%, at least 98%, at least 99%, or 100%, amino acid sequence identity to an amino acid sequence set forth in SEQ ID NO:132-133. In some cases, the MAL polypeptide comprises an amino acid sequence having at least 85%, at least 90%, at least 95%, at least 98%, at least 99%, or 100%, amino acid sequence identity to an amino acid sequence set forth in SEQ ID NO:309-312.

In some cases, an antigen combination for targeting a pancreatic ductal carcinoma cell comprises NOX4 AND CEACAM6. In some cases, the NOX4 polypeptide comprises an amino acid sequence having at least 85%, at least 90%, at least 95%, at least 98%, at least 99%, or 100%, amino acid sequence identity to an amino acid sequence set forth in SEQ ID NO:359-364. In some cases, the CEACAM6 polypeptide comprises an amino acid sequence having at least 85%, at least 90%, at least 95%, at least 98%, at least 99%, or 100%, amino acid sequence identity to an amino acid sequence set forth in SEQ ID NO:127.

Renal Cell Carcinoma Target Antigen Combinations

In some cases, an antigen combination for targeting a renal cell carcinoma cell comprises CD70 AND CA9. In some cases, the CD70 polypeptide comprises an amino acid sequence having at least 85%, at least 90%, at least 95%, at least 98%, at least 99%, or 100%, amino acid sequence identity to an amino acid sequence set forth in SEQ ID NO:95-96. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a renal cell carcinoma cell comprises CD70 AND FOLR1. In some cases, the CD70 polypeptide comprises an amino acid sequence having at least 85%, at least 90%, at least 95%, at least 98%, at least 99%, or 100%, amino acid sequence identity to an amino acid sequence set forth in SEQ ID NO:95-96. In some cases, the FOLR1 polypeptide comprises an amino acid sequence having at least 85%, at least 90%, at least 95%, at least 98%, at least 99%, or 100%, amino acid sequence identity to an amino acid sequence set forth in SEQ ID NO:198-201.

In some cases, an antigen combination for targeting a renal cell carcinoma cell comprises CDH6 AND CA9. In some cases, the CDH6 polypeptide comprises an amino acid sequence having at least 85%, at least 90%, at least 95%, at least 98%, at least 99%, or 100%, amino acid sequence identity to an amino acid sequence set forth in SEQ ID NO:120. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a renal cell carcinoma cell comprises KCNJ16 AND AXL. In some cases, the KCNJ16 polypeptide comprises an amino acid sequence having at least 85%, at least 90%, at least 95%, at least 98%, at least 99%, or 100%, amino acid sequence identity to an amino acid sequence set forth in SEQ ID NO:264-271. In some cases, the AXL polypeptide comprises an amino acid sequence having at least 85%, at least 90%, at least 95%, at least 98%, at least 99%, or 100%, amino acid sequence identity to an amino acid sequence set forth in SEQ ID NO:38-39.

In some cases, an antigen combination for targeting a renal cell carcinoma cell comprises LRP2 AND AXL. In some cases, the LRP2 polypeptide comprises an amino acid sequence having at least 85%, at least 90%, at least 95%, at least 98%, at least 99%, or 100%, amino acid sequence identity to an amino acid sequence set forth in SEQ ID NO:295. In some cases, the AXL polypeptide comprises an amino acid sequence having at least 85%, at least 90%, at least 95%, at least 98%, at least 99%, or 100%, amino acid sequence identity to an amino acid sequence set forth in SEQ ID NO:38-39.

In some cases, an antigen combination for targeting a renal cell carcinoma cell comprises LRP2 AND CA9. In some cases, the LRP2 polypeptide comprises an amino acid sequence having at least 85%, at least 90%, at least 95%, at least 98%, at least 99%, or 100%, amino acid sequence identity to an amino acid sequence set forth in SEQ ID NO:295. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a renal cell carcinoma cell comprises SLC16A4 AND AXL. In some cases, the SLC16A4 polypeptide comprises an amino acid sequence having at least 85%, at least 90%, at least 95%, at least 98%, at least 99%, or 100%, amino acid sequence identity to an amino acid sequence set forth in SEQ ID NO:461-465. In some cases, the AXL polypeptide comprises an amino acid sequence having at least 85%, at least 90%, at least 95%, at least 98%, at least 99%, or 100%, amino acid sequence identity to an amino acid sequence set forth in SEQ ID NO:38-39.

In some cases, an antigen combination for targeting a renal cell carcinoma cell comprises SLC3A1 AND AXL. In some cases, the SLC3A1 polypeptide comprises an amino acid sequence having at least 85%, at least 90%, at least 95%, at least 98%, at least 99%, or 100%, amino acid sequence identity to an amino acid sequence set forth in SEQ ID NO:489. In some cases, the AXL polypeptide comprises an amino acid sequence having at least 85%, at least 90%, at least 95%, at least 98%, at least 99%, or 100%, amino acid sequence identity to an amino acid sequence set forth in SEQ ID NO:38-39.

In some cases, an antigen combination for targeting a renal cell carcinoma cell comprises SLC3A1 AND CA9. In some cases, the SLC3A1 polypeptide comprises an amino acid sequence having at least 85%, at least 90%, at least 95%, at least 98%, at least 99%, or 100%, amino acid sequence identity to an amino acid sequence set forth in SEQ ID NO:489. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a renal cell carcinoma cell comprises TMEM27 AND CA9. In some cases, the TMEM27 polypeptide comprises an amino acid sequence having at least 85%, at least 90%, at least 95%, at least 98%, at least 99%, or 100%, amino acid sequence identity to an amino acid sequence set forth in SEQ ID NO:522. In some cases, the CA9 polypeptide comprises an amino acid sequence having at least 85%, at least 90%, at least 95%, at least 98%, at least 99%, or 100%, amino acid sequence identity to an amino acid sequence set forth in SEQ ID NO:68.

In some cases, an antigen combination for targeting a renal cell carcinoma cell comprises AXL AND NOT-PDGFRA. In some cases, the AXL polypeptide comprises an amino acid sequence having at least 85%, at least 90%, at least 95%, at least 98%, at least 99%, or 100%, amino acid sequence identity to an amino acid sequence set forth in SEQ ID NO:38-39. In some cases, the PDGFRA polypeptide comprises an amino acid sequence having at least 85%, at least 90%, at least 95%, at least 98%, at least 99%, or 100%, amino acid sequence identity to an amino acid sequence set forth in SEQ ID NO:399-400.

In some cases, an antigen combination for targeting a renal cell carcinoma cell comprises CD70 AND NOT-ADRB2. In some cases, the CD70 polypeptide comprises an amino acid sequence having at least 85%, at least 90%, at least 95%, at least 98%, at least 99%, or 100%, amino acid sequence identity to an amino acid sequence set forth in SEQ ID NO:95-96. In some cases, the ADRB2 polypeptide comprises an amino acid sequence having at least 85%, at least 90%, at least 95%, at least 98%, at least 99%, or 100%, amino acid sequence identity to an amino acid sequence set forth in SEQ ID NO:25.

In some cases, an antigen combination for targeting a renal cell carcinoma cell comprises CLDN2 AND PCDHB10. In some cases, the CLDN2 polypeptide comprises an amino acid sequence having at least 85%, at least 90%, at least 95%, at least 98%, at least 99%, or 100%, amino acid sequence identity to an amino acid sequence set forth in SEQ ID NO:134-136. In some cases, the PCDHB10 polypeptide comprises an amino acid sequence having at least 85%, at least 90%, at least 95%, at least 98%, at least 99%, or 100%, amino acid sequence identity to an amino acid sequence set forth in SEQ ID NO:398.

In some cases, an antigen combination for targeting a renal cell carcinoma cell comprises ENPEP AND ROR2. In some cases, the ENPEP polypeptide comprises an amino acid sequence having at least 85%, at least 90%, at least 95%, at least 98%, at least 99%, or 100%, amino acid sequence identity to an amino acid sequence set forth in SEQ ID NO:171. In some cases, the ROR2 polypeptide comprises an amino acid sequence having at least 85%, at least 90%, at least 95%, at least 98%, at least 99%, or 100%, amino acid sequence identity to an amino acid sequence set forth in SEQ ID NO:438-439.

In some cases, an antigen combination for targeting a renal cell carcinoma cell comprises ENPP3 AND ROR2. In some cases, the ENPP3 polypeptide comprises an amino acid sequence having at least 85%, at least 90%, at least 95%, at least 98%, at least 99%, or 100%, amino acid sequence identity to an amino acid sequence set forth in SEQ ID NO:172-172. In some cases, the ROR2 polypeptide comprises an amino acid sequence having at least 85%, at least 90%, at least 95%, at least 98%, at least 99%, or 100%, amino acid sequence identity to an amino acid sequence set forth in SEQ ID NO:438-439.

In some cases, an antigen combination for targeting a renal cell carcinoma cell comprises EPHA7 AND SLCO4C1. In some cases, the EPHA7 polypeptide comprises an amino acid sequence having at least 85%, at least 90%, at least 95%, at least 98%, at least 99%, or 100%, amino acid sequence identity to an amino acid sequence set forth in SEQ ID NO:175-177. In some cases, the SLCO4C1 polypeptide comprises an amino acid sequence having at least 85%, at least 90%, at least 95%, at least 98%, at least 99%, or 100%, amino acid sequence identity to an amino acid sequence set forth in SEQ ID NO:504.

In some cases, an antigen combination for targeting a renal cell carcinoma cell comprises MAGT1 AND ROR2. In some cases, the MAGT1 polypeptide comprises an amino acid sequence having at least 85%, at least 90%, at least 95%, at least 98%, at least 99%, or 100%, amino acid sequence identity to an amino acid sequence set forth in SEQ ID NO:308. In some cases, the ROR2 polypeptide comprises an amino acid sequence having at least 85%, at least 90%, at least 95%, at least 98%, at least 99%, or 100%, amino acid sequence identity to an amino acid sequence set forth in SEQ ID NO:438-439.

In some cases, an antigen combination for targeting a renal cell carcinoma cell comprises SLC3A1 AND ROR2. In some cases, the SLC3A1 polypeptide comprises an amino acid sequence having at least 85%, at least 90%, at least 95%, at least 98%, at least 99%, or 100%, amino acid sequence identity to an amino acid sequence set forth in SEQ ID NO:489. In some cases, the ROR2 polypeptide comprises an amino acid sequence having at least 85%, at least 90%, at least 95%, at least 98%, at least 99%, or 100%, amino acid sequence identity to an amino acid sequence set forth in SEQ ID NO:438-439.

In some cases, an antigen combination for targeting a renal cell carcinoma cell comprises NOT-GPM6B AND ROR2. In some cases, the GPM6B polypeptide comprises an amino acid sequence having at least 85%, at least 90%, at least 95%, at least 98%, at least 99%, or 100%, amino acid sequence identity to an amino acid sequence set forth in SEQ ID NO:223-226. In some cases, the ROR2 polypeptide comprises an amino acid sequence having at least 85%, at least 90%, at least 95%, at least 98%, at least 99%, or 100%, amino acid sequence identity to an amino acid sequence set forth in SEQ ID NO:438-439.

In some cases, an antigen combination for targeting a renal cell carcinoma cell comprises SLC22A2 AND NOT-CLCNKB. In some cases, the SLC22A2 polypeptide comprises an amino acid sequence having at least 85%, at least 90%, at least 95%, at least 98%, at least 99%, or 100%, amino acid sequence identity to an amino acid sequence set forth in SEQ ID NO:472. In some cases, the CLCNKB polypeptide comprises an amino acid sequence having at least 85%, at least 90%, at least 95%, at least 98%, at least 99%, or 100%, amino acid sequence identity to an amino acid sequence set forth in SEQ ID NO:128-129.

In some cases, an antigen combination for targeting a renal cell carcinoma cell comprises SLC22A2 AND NOT-KCNJ1. In some cases, the SLC22A2 polypeptide comprises an amino acid sequence having at least 85%, at least 90%, at least 95%, at least 98%, at least 99%, or 100%, amino acid sequence identity to an amino acid sequence set forth in SEQ ID NO:472. In some cases, the KCNJ1 polypeptide comprises an amino acid sequence having at least 85%, at least 90%, at least 95%, at least 98%, at least 99%, or 100%, amino acid sequence identity to an amino acid sequence set forth in SEQ ID NO:259-263.

Soft Tissue Sarcoma Target Antigen Combinations

In some cases, an antigen combination for targeting a soft tissue sarcoma cell comprises BIRC5 AND B4GALNT1. In some cases, the BIRC5 polypeptide comprises an amino acid sequence having at least 85%, at least 90%, at least 95%, at least 98%, at least 99%, or 100%, amino acid sequence identity to an amino acid sequence set forth in SEQ ID NO:57-59. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a soft tissue sarcoma cell comprises CD99 AND B4GALNT1. In some cases, the CD99 polypeptide comprises an amino acid sequence having at least 85%, at least 90%, at least 95%, at least 98%, at least 99%, or 100%, amino acid sequence identity to an amino acid sequence set forth in SEQ ID NO:108-112. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a soft tissue sarcoma cell comprises CDH11 AND B4GALNT1. In some cases, the CDH11 polypeptide comprises an amino acid sequence having at least 85%, at least 90%, at least 95%, at least 98%, at least 99%, or 100%, amino acid sequence identity to an amino acid sequence set forth in SEQ ID NO:118-119. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a soft tissue sarcoma cell comprises HTRA2 AND B4GALNT1. In some cases, the HTRA2 polypeptide comprises an amino acid sequence having at least 85%, at least 90%, at least 95%, at least 98%, at least 99%, or 100%, amino acid sequence identity to an amino acid sequence set forth in SEQ ID NO:239-241. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a soft tissue sarcoma cell comprises NOT-ATP13A4 AND ROR1. In some cases, the ATP13A4 polypeptide comprises an amino acid sequence having at least 85%, at least 90%, at least 95%, at least 98%, at least 99%, or 100%, amino acid sequence identity to an amino acid sequence set forth in SEQ ID NO:35. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a soft tissue sarcoma cell comprises NOT-Clorf210 AND ERBB2. In some cases, the Clorf210 polypeptide comprises an amino acid sequence having at least 85%, at least 90%, at least 95%, at least 98%, at least 99%, or 100%, amino acid sequence identity to an amino acid sequence set forth in SEQ ID NO:62-63. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a soft tissue sarcoma cell comprises NOT-Clorf210 AND ROR1. In some cases, the Clorf210 polypeptide comprises an amino acid sequence having at least 85%, at least 90%, at least 95%, at least 98%, at least 99%, or 100%, amino acid sequence identity to an amino acid sequence set forth in SEQ ID NO:62-63. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a soft tissue sarcoma cell comprises NOT-CDH1 AND ROR1. In some cases, the CDH1 polypeptide comprises an amino acid sequence having at least 85%, at least 90%, at least 95%, at least 98%, at least 99%, or 100%, amino acid sequence identity to an amino acid sequence set forth in SEQ ID NO:113-116. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a soft tissue sarcoma cell comprises NOT-ITGB6 AND ERBB2. In some cases, the ITGB6 polypeptide comprises an amino acid sequence having at least 85%, at least 90%, at least 95%, at least 98%, at least 99%, or 100%, amino acid sequence identity to an amino acid sequence set forth in SEQ ID NO:251-254. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a soft tissue sarcoma cell comprises NOT-LSR AND ERBB2. In some cases, the LSR polypeptide comprises an amino acid sequence having at least 85%, at least 90%, at least 95%, at least 98%, at least 99%, or 100%, amino acid sequence identity to an amino acid sequence set forth in SEQ ID NO:302-306. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a soft tissue sarcoma cell comprises NOT-SCNN1A AND ERBB2. In some cases, the SCNN1A polypeptide comprises an amino acid sequence having at least 85%, at least 90%, at least 95%, at least 98%, at least 99%, or 100%, amino acid sequence identity to an amino acid sequence set forth in SEQ ID NO:449-451. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a soft tissue sarcoma cell comprises NOT-SLC26A9 AND ROR1. In some cases, the SLC26A9 polypeptide comprises an amino acid sequence having at least 85%, at least 90%, at least 95%, at least 98%, at least 99%, or 100%, amino acid sequence identity to an amino acid sequence set forth in SEQ ID NO:473-474. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a soft tissue sarcoma cell comprises NOT-SLC2A12 AND ERBB2. In some cases, the SLC2A12 polypeptide comprises an amino acid sequence having at least 85%, at least 90%, at least 95%, at least 98%, at least 99%, or 100%, amino acid sequence identity to an amino acid sequence set forth in SEQ ID NO:477. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a soft tissue sarcoma cell comprises NOT-SLC6A14 AND ROR1. In some cases, the SLC6A14 polypeptide comprises an amino acid sequence having at least 85%, at least 90%, at least 95%, at least 98%, at least 99%, or 100%, amino acid sequence identity to an amino acid sequence set forth in SEQ ID NO:495. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a soft tissue sarcoma cell comprises LINGO1 AND NOT-NALCN. In some cases, the LINGO1 polypeptide comprises an amino acid sequence having at least 85%, at least 90%, at least 95%, at least 98%, at least 99%, or 100%, amino acid sequence identity to an amino acid sequence set forth in SEQ ID NO:282-293. In some cases, the NALCN polypeptide comprises an amino acid sequence having at least 85%, at least 90%, at least 95%, at least 98%, at least 99%, or 100%, amino acid sequence identity to an amino acid sequence set forth in SEQ ID NO:342.

In some cases, an antigen combination for targeting a soft tissue sarcoma cell comprises THY1 AND NOT-NDRG4. In some cases, the THY1 polypeptide comprises an amino acid sequence having at least 85%, at least 90%, at least 95%, at least 98%, at least 99%, or 100%, amino acid sequence identity to an amino acid sequence set forth in SEQ ID NO:514-516. In some cases, the NDRG4 polypeptide comprises an amino acid sequence having at least 85%, at least 90%, at least 95%, at least 98%, at least 99%, or 100%, amino acid sequence identity to an amino acid sequence set forth in SEQ ID NO:343-349.

Hepatocellular Carcinoma Target Antigen Combinations

In some cases, an antigen combination for targeting a hepatocellular carcinoma cell comprises CLDN15 AND GPC3. In some cases, the CLDN15 polypeptide comprises an amino acid sequence having at least 85%, at least 90%, at least 95%, at least 98%, at least 99%, or 100%, amino acid sequence identity to an amino acid sequence set forth in SEQ ID NO:130-131. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a hepatocellular carcinoma cell comprises MET AND NOT-TPBG. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314. In some cases, the TPBG polypeptide comprises an amino acid sequence having at least 85%, at least 90%, at least 95%, at least 98%, at least 99%, or 100%, amino acid sequence identity to an amino acid sequence set forth in SEQ ID NO:526-527.

In some cases, an antigen combination for targeting a hepatocellular carcinoma cell comprises ABCC6 AND GPC3. In some cases, the ABCC6 polypeptide comprises an amino acid sequence having at least 85%, at least 90%, at least 95%, at least 98%, at least 99%, or 100%, amino acid sequence identity to an amino acid sequence set forth in SEQ ID NO:1-2. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a hepatocellular carcinoma cell comprises ACSL6 AND EPCAM. In some cases, the ACSL6 polypeptide comprises an amino acid sequence having at least 85%, at least 90%, at least 95%, at least 98%, at least 99%, or 100%, amino acid sequence identity to an amino acid sequence set forth in SEQ ID NO:3-8. In some cases, the EPCAM polypeptide comprises an amino acid sequence having at least 85%, at least 90%, at least 95%, at least 98%, at least 99%, or 100%, amino acid sequence identity to an amino acid sequence set forth in SEQ ID NO:173.

In some cases, an antigen combination for targeting a hepatocellular carcinoma cell comprises C1QTNF1 AND EPCAM. In some cases, the C1QTNF1 polypeptide comprises an amino acid sequence having at least 85%, at least 90%, at least 95%, at least 98%, at least 99%, or 100%, amino acid sequence identity to an amino acid sequence set forth in SEQ ID NO:64-67. In some cases, the EPCAM polypeptide comprises an amino acid sequence having at least 85%, at least 90%, at least 95%, at least 98%, at least 99%, or 100%, amino acid sequence identity to an amino acid sequence set forth in SEQ ID NO:173.

In some cases, an antigen combination for targeting a hepatocellular carcinoma cell comprises GPR88 AND EPCAM. In some cases, the GPR88 polypeptide comprises an amino acid sequence having at least 85%, at least 90%, at least 95%, at least 98%, at least 99%, or 100%, amino acid sequence identity to an amino acid sequence set forth in SEQ ID NO:234. In some cases, the EPCAM polypeptide comprises an amino acid sequence having at least 85%, at least 90%, at least 95%, at least 98%, at least 99%, or 100%, amino acid sequence identity to an amino acid sequence set forth in SEQ ID NO:173.

In some cases, an antigen combination for targeting a hepatocellular carcinoma cell comprises PAQR9 AND EPCAM. In some cases, the PAQR9 polypeptide comprises an amino acid sequence having at least 85%, at least 90%, at least 95%, at least 98%, at least 99%, or 100%, amino acid sequence identity to an amino acid sequence set forth in SEQ ID NO:393. In some cases, the EPCAM polypeptide comprises an amino acid sequence having at least 85%, at least 90%, at least 95%, at least 98%, at least 99%, or 100%, amino acid sequence identity to an amino acid sequence set forth in SEQ ID NO:173.

In some cases, an antigen combination for targeting a hepatocellular carcinoma cell comprises SLC2A2 AND GPC3. In some cases, the SLC2A2 polypeptide comprises an amino acid sequence having at least 85%, at least 90%, at least 95%, at least 98%, at least 99%, or 100%, amino acid sequence identity to an amino acid sequence set forth in SEQ ID NO:478-480. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a hepatocellular carcinoma cell comprises SLC30A10 AND GPC3. In some cases, the SLC30A10 polypeptide comprises an amino acid sequence having at least 85%, at least 90%, at least 95%, at least 98%, at least 99%, or 100%, amino acid sequence identity to an amino acid sequence set forth in SEQ ID NO:481. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a hepatocellular carcinoma cell comprises SLCO1B1 AND GPC3. In some cases, the SLCO1B1 polypeptide comprises an amino acid sequence having at least 85%, at least 90%, at least 95%, at least 98%, at least 99%, or 100%, amino acid sequence identity to an amino acid sequence set forth in SEQ ID NO:503. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a hepatocellular carcinoma cell comprises NOT-FXYD3 AND EPCAM. In some cases, the FXYD3 polypeptide comprises an amino acid sequence having at least 85%, at least 90%, at least 95%, at least 98%, at least 99%, or 100%, amino acid sequence identity to an amino acid sequence set forth in SEQ ID NO:202-209. In some cases, the EPCAM polypeptide comprises an amino acid sequence having at least 85%, at least 90%, at least 95%, at least 98%, at least 99%, or 100%, amino acid sequence identity to an amino acid sequence set forth in SEQ ID NO:173.

In some cases, an antigen combination for targeting a hepatocellular carcinoma cell comprises AFP AND ALCAM. In some cases, the AFP polypeptide comprises an amino acid sequence having at least 85%, at least 90%, at least 95%, at least 98%, at least 99%, or 100%, amino acid sequence identity to an amino acid sequence set forth in SEQ ID NO:26. In some cases, the ALCAM polypeptide comprises an amino acid sequence having at least 85%, at least 90%, at least 95%, at least 98%, at least 99%, or 100%, amino acid sequence identity to an amino acid sequence set forth in SEQ ID NO:27-29.

In some cases, an antigen combination for targeting a hepatocellular carcinoma cell comprises AFP AND CNNM3. In some cases, the AFP polypeptide comprises an amino acid sequence having at least 85%, at least 90%, at least 95%, at least 98%, at least 99%, or 100%, amino acid sequence identity to an amino acid sequence set forth in SEQ ID NO:26. In some cases, the CNNM3 polypeptide comprises an amino acid sequence having at least 85%, at least 90%, at least 95%, at least 98%, at least 99%, or 100%, amino acid sequence identity to an amino acid sequence set forth in SEQ ID NO:146-147.

In some cases, an antigen combination for targeting a hepatocellular carcinoma cell comprises AFP AND ERBB3. In some cases, the AFP polypeptide comprises an amino acid sequence having at least 85%, at least 90%, at least 95%, at least 98%, at least 99%, or 100%, amino acid sequence identity to an amino acid sequence set forth in SEQ ID NO:26. In some cases, the ERBB3 polypeptide comprises an amino acid sequence having at least 85%, at least 90%, at least 95%, at least 98%, at least 99%, or 100%, amino acid sequence identity to an amino acid sequence set forth in SEQ ID NO:183-184.

In some cases, an antigen combination for targeting a hepatocellular carcinoma cell comprises AFP AND LRRC8D. In some cases, the AFP polypeptide comprises an amino acid sequence having at least 85%, at least 90%, at least 95%, at least 98%, at least 99%, or 100%, amino acid sequence identity to an amino acid sequence set forth in SEQ ID NO:26. In some cases, the LRRC8D polypeptide comprises an amino acid sequence having at least 85%, at least 90%, at least 95%, at least 98%, at least 99%, or 100%, amino acid sequence identity to an amino acid sequence set forth in SEQ ID NO:296-297.

In some cases, an antigen combination for targeting a hepatocellular carcinoma cell comprises AFP AND SLC38A6. In some cases, the AFP polypeptide comprises an amino acid sequence having at least 85%, at least 90%, at least 95%, at least 98%, at least 99%, or 100%, amino acid sequence identity to an amino acid sequence set forth in SEQ ID NO:26. In some cases, the SLC38A6 polypeptide comprises an amino acid sequence having at least 85%, at least 90%, at least 95%, at least 98%, at least 99%, or 100%, amino acid sequence identity to an amino acid sequence set forth in SEQ ID NO:487-488.

In some cases, an antigen combination for targeting a hepatocellular carcinoma cell comprises SLC17A2 AND NOT-CLEC4M. In some cases, the SLC17A2 polypeptide comprises an amino acid sequence having at least 85%, at least 90%, at least 95%, at least 98%, at least 99%, or 100%, amino acid sequence identity to an amino acid sequence set forth in SEQ ID NO:466-468. In some cases, the CLEC4M polypeptide comprises an amino acid sequence having at least 85%, at least 90%, at least 95%, at least 98%, at least 99%, or 100%, amino acid sequence identity to an amino acid sequence set forth in SEQ ID NO:138-145.

Acute Myeloid Leukemia (AML) Target Antigen Combinations

In some cases, an antigen combination for targeting a acute myeloid leukemia cell comprises CSF3R AND CD70. In some cases, the CSF3R polypeptide comprises an amino acid sequence having at least 85%, at least 90%, at least 95%, at least 98%, at least 99%, or 100%, amino acid sequence identity to an amino acid sequence set forth in SEQ ID NO:152-154. In some cases, the CD70 polypeptide comprises an amino acid sequence having at least 85%, at least 90%, at least 95%, at least 98%, at least 99%, or 100%, amino acid sequence identity to an amino acid sequence set forth in SEQ ID NO:95-96.

In some cases, an antigen combination for targeting a acute myeloid leukemia cell comprises NOT-CADM1 AND CD70. In some cases, the CADM1 polypeptide comprises an amino acid sequence having at least 85%, at least 90%, at least 95%, at least 98%, at least 99%, or 100%, amino acid sequence identity to an amino acid sequence set forth in SEQ ID NO:69-73. In some cases, the CD70 polypeptide comprises an amino acid sequence having at least 85%, at least 90%, at least 95%, at least 98%, at least 99%, or 100%, amino acid sequence identity to an amino acid sequence set forth in SEQ ID NO:95-96.

In some cases, an antigen combination for targeting a acute myeloid leukemia cell comprises NOT-HEG1 AND MUC1. In some cases, the HEG1 polypeptide comprises an amino acid sequence having at least 85%, at least 90%, at least 95%, at least 98%, at least 99%, or 100%, amino acid sequence identity to an amino acid sequence set forth in SEQ ID NO:237. In some cases, the MUC1 polypeptide comprises an amino acid sequence having at least 85%, at least 90%, at least 95%, at least 98%, at least 99%, or 100%, amino acid sequence identity to an amino acid sequence set forth in SEQ ID NO:321-340.

In some cases, an antigen combination for targeting a acute myeloid leukemia cell comprises NOT-ALDH1A1 AND IL3RA. In some cases, the ALDH1A1 polypeptide comprises an amino acid sequence having at least 85%, at least 90%, at least 95%, at least 98%, at least 99%, or 100%, amino acid sequence identity to an amino acid sequence set forth in SEQ ID NO:30. In some cases, the IL3RA polypeptide comprises an amino acid sequence having at least 85%, at least 90%, at least 95%, at least 98%, at least 99%, or 100%, amino acid sequence identity to an amino acid sequence set forth in SEQ ID NO:249-250.

In some cases, an antigen combination for targeting a acute myeloid leukemia cell comprises NOT-HEG1 AND IL3RA. In some cases, the HEG1 polypeptide comprises an amino acid sequence having at least 85%, at least 90%, at least 95%, at least 98%, at least 99%, or 100%, amino acid sequence identity to an amino acid sequence set forth in SEQ ID NO:237. In some cases, the IL3RA polypeptide comprises an amino acid sequence having at least 85%, at least 90%, at least 95%, at least 98%, at least 99%, or 100%, amino acid sequence identity to an amino acid sequence set forth in SEQ ID NO:249-250.

In some cases, an antigen combination for targeting a acute myeloid leukemia cell comprises NOT-TGFBR3 AND IL3RA. In some cases, the TGFBR3 polypeptide comprises an amino acid sequence having at least 85%, at least 90%, at least 95%, at least 98%, at least 99%, or 100%, amino acid sequence identity to an amino acid sequence set forth in SEQ ID NO:511-513. In some cases, the IL3RA polypeptide comprises an amino acid sequence having at least 85%, at least 90%, at least 95%, at least 98%, at least 99%, or 100%, amino acid sequence identity to an amino acid sequence set forth in SEQ ID NO:249-250.

In some cases, an antigen combination for targeting a acute myeloid leukemia cell comprises NOT-WLS AND IL3RA. In some cases, the WLS polypeptide comprises an amino acid sequence having at least 85%, at least 90%, at least 95%, at least 98%, at least 99%, or 100%, amino acid sequence identity to an amino acid sequence set forth in SEQ ID NO:539-541. In some cases, the IL3RA polypeptide comprises an amino acid sequence having at least 85%, at least 90%, at least 95%, at least 98%, at least 99%, or 100%, amino acid sequence identity to an amino acid sequence set forth in SEQ ID NO:249-250.

In some cases, an antigen combination for targeting a acute myeloid leukemia cell comprises NOT-WLS AND PROM1. In some cases, the WLS polypeptide comprises an amino acid sequence having at least 85%, at least 90%, at least 95%, at least 98%, at least 99%, or 100%, amino acid sequence identity to an amino acid sequence set forth in SEQ ID NO:539-541. In some cases, the PROM1 polypeptide comprises an amino acid sequence having at least 85%, at least 90%, at least 95%, at least 98%, at least 99%, or 100%, amino acid sequence identity to an amino acid sequence set forth in SEQ ID NO:421-427.

Colon Cancer Target Antigen Combinations

In some cases, an antigen combination for targeting a colon cancer cell comprises AMIGO2 AND CEACAM5. In some cases, the AMIGO2 polypeptide comprises an amino acid sequence having at least 85%, at least 90%, at least 95%, at least 98%, at least 99%, or 100%, amino acid sequence identity to an amino acid sequence set forth in SEQ ID NO:31-32. In some cases, the CEACAM5 polypeptide comprises an amino acid sequence having at least 85%, at least 90%, at least 95%, at least 98%, at least 99%, or 100%, amino acid sequence identity to an amino acid sequence set forth in SEQ ID NO:124-126.

In some cases, an antigen combination for targeting a colon cancer cell comprises BFAR AND EGFR. In some cases, the BFAR polypeptide comprises an amino acid sequence having at least 85%, at least 90%, at least 95%, at least 98%, at least 99%, or 100%, amino acid sequence identity to an amino acid sequence set forth in SEQ ID NO:56. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a colon cancer cell comprises NOT-GPR1 AND EGFR. In some cases, the GPR1 polypeptide comprises an amino acid sequence having at least 85%, at least 90%, at least 95%, at least 98%, at least 99%, or 100%, amino acid sequence identity to an amino acid sequence set forth in SEQ ID NO:227-232. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a colon cancer cell comprises NOT-KCNJ5 AND EGFR. In some cases, the KCNJ5 polypeptide comprises an amino acid sequence having at least 85%, at least 90%, at least 95%, at least 98%, at least 99%, or 100%, amino acid sequence identity to an amino acid sequence set forth in SEQ ID NO:272. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a colon cancer cell comprises NOT-LIFR AND FAP. In some cases, the LIFR polypeptide comprises an amino acid sequence having at least 85%, at least 90%, at least 95%, at least 98%, at least 99%, or 100%, amino acid sequence identity to an amino acid sequence set forth in SEQ ID NO:280-281. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190.

In some cases, an antigen combination for targeting a colon cancer cell comprises NOT-PCDH9 AND EGFR. In some cases, the PCDH9 polypeptide comprises an amino acid sequence having at least 85%, at least 90%, at least 95%, at least 98%, at least 99%, or 100%, amino acid sequence identity to an amino acid sequence set forth in SEQ ID NO:394-397. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

In some cases, an antigen combination for targeting a colon cancer cell comprises NOT-SLC46A1 AND EGFR. In some cases, the SLC46A1 polypeptide comprises an amino acid sequence having at least 85%, at least 90%, at least 95%, at least 98%, at least 99%, or 100%, amino acid sequence identity to an amino acid sequence set forth in SEQ ID NO:490-491. In some cases, the EGFR polypeptide comprises an amino acid sequence having at least 85%, at least 90%, at least 95%, at least 98%, at least 99%, or 100%, amino acid sequence identity to an amino acid sequence set forth in SEQ ID NO:167-170.

Gastric Cancer Target Antigen Combinations

In some cases, an antigen combination for targeting a gastric cancer cell comprises PSCA AND DLL4. In some cases, the PSCA polypeptide comprises an amino acid sequence having at least 85%, at least 90%, at least 95%, at least 98%, at least 99%, or 100%, amino acid sequence identity to an amino acid sequence set forth in SEQ ID NO:542-543. In some cases, the DLL4 polypeptide comprises an amino acid sequence having at least 85%, at least 90%, at least 95%, at least 98%, at least 99%, or 100%, amino acid sequence identity to an amino acid sequence set forth in SEQ ID NO:166.

In some cases, an antigen combination for targeting a gastric cancer cell comprises CLDN2 AND DLL4. In some cases, the CLDN2 polypeptide comprises an amino acid sequence having at least 85%, at least 90%, at least 95%, at least 98%, at least 99%, or 100%, amino acid sequence identity to an amino acid sequence set forth in SEQ ID NO:134-136. In some cases, the DLL4 polypeptide comprises an amino acid sequence having at least 85%, at least 90%, at least 95%, at least 98%, at least 99%, or 100%, amino acid sequence identity to an amino acid sequence set forth in SEQ ID NO:166.

In some cases, an antigen combination for targeting a gastric cancer cell comprises CXCL9 AND DLL4. In some cases, the CXCL9 polypeptide comprises an amino acid sequence having at least 85%, at least 90%, at least 95%, at least 98%, at least 99%, or 100%, amino acid sequence identity to an amino acid sequence set forth in SEQ ID NO:155. In some cases, the DLL4 polypeptide comprises an amino acid sequence having at least 85%, at least 90%, at least 95%, at least 98%, at least 99%, or 100%, amino acid sequence identity to an amino acid sequence set forth in SEQ ID NO:166.

In some cases, an antigen combination for targeting a gastric cancer cell comprises F2RL2 AND DLL4. In some cases, the F2RL2 polypeptide comprises an amino acid sequence having at least 85%, at least 90%, at least 95%, at least 98%, at least 99%, or 100%, amino acid sequence identity to an amino acid sequence set forth in SEQ ID NO:187-188. In some cases, the DLL4 polypeptide comprises an amino acid sequence having at least 85%, at least 90%, at least 95%, at least 98%, at least 99%, or 100%, amino acid sequence identity to an amino acid sequence set forth in SEQ ID NO:166.

In some cases, an antigen combination for targeting a gastric cancer cell comprises MUC13 AND DKK1. In some cases, the MUC13 polypeptide comprises an amino acid sequence having at least 85%, at least 90%, at least 95%, at least 98%, at least 99%, or 100%, amino acid sequence identity to an amino acid sequence set forth in SEQ ID NO:341. In some cases, the DKK1 polypeptide comprises an amino acid sequence having at least 85%, at least 90%, at least 95%, at least 98%, at least 99%, or 100%, amino acid sequence identity to an amino acid sequence set forth in SEQ ID NO:163.

In some cases, an antigen combination for targeting a gastric cancer cell comprises VSIG1 AND DLL4. In some cases, the VSIG1 polypeptide comprises an amino acid sequence having at least 85%, at least 90%, at least 95%, at least 98%, at least 99%, or 100%, amino acid sequence identity to an amino acid sequence set forth in SEQ ID NO:534-535. In some cases, the DLL4 polypeptide comprises an amino acid sequence having at least 85%, at least 90%, at least 95%, at least 98%, at least 99%, or 100%, amino acid sequence identity to an amino acid sequence set forth in SEQ ID NO:166.

Melanoma Target Antigen Combinations

In some cases, an antigen combination for targeting a melanoma cell comprises BAMBI AND B4GALNT1. In some cases, the BAMBI polypeptide comprises an amino acid sequence having at least 85%, at least 90%, at least 95%, at least 98%, at least 99%, or 100%, amino acid sequence identity to an amino acid sequence set forth in SEQ ID NO:43. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a melanoma cell comprises C11orf24 AND KDR. In some cases, the C11orf24 polypeptide comprises an amino acid sequence having at least 85%, at least 90%, at least 95%, at least 98%, at least 99%, or 100%, amino acid sequence identity to an amino acid sequence set forth in SEQ ID NO:60-61. In some cases, the KDR polypeptide comprises an amino acid sequence having at least 85%, at least 90%, at least 95%, at least 98%, at least 99%, or 100%, amino acid sequence identity to an amino acid sequence set forth in SEQ ID NO:274.

In some cases, an antigen combination for targeting a melanoma cell comprises GPR19 AND ERBB2. In some cases, the GPR19 polypeptide comprises an amino acid sequence having at least 85%, at least 90%, at least 95%, at least 98%, at least 99%, or 100%, amino acid sequence identity to an amino acid sequence set forth in SEQ ID NO:233. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a melanoma cell comprises ST3GAL5 AND FAP. In some cases, the ST3GAL5 polypeptide comprises an amino acid sequence having at least 85%, at least 90%, at least 95%, at least 98%, at least 99%, or 100%, amino acid sequence identity to an amino acid sequence set forth in SEQ ID NO:507-508. In some cases, the FAP polypeptide comprises an amino acid sequence having at least 85%, at least 90%, at least 95%, at least 98%, at least 99%, or 100%, amino acid sequence identity to an amino acid sequence set forth in SEQ ID NO:189-190.

In some cases, an antigen combination for targeting a melanoma cell comprises TNFSF9 AND MET. In some cases, the TNFSF9 polypeptide comprises an amino acid sequence having at least 85%, at least 90%, at least 95%, at least 98%, at least 99%, or 100%, amino acid sequence identity to an amino acid sequence set forth in SEQ ID NO:525. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313.

In some cases, an antigen combination for targeting a melanoma cell comprises NOT-ADAM29 AND MET. In some cases, the ADAM29 polypeptide comprises an amino acid sequence having at least 85%, at least 90%, at least 95%, at least 98%, at least 99%, or 100%, amino acid sequence identity to an amino acid sequence set forth in SEQ ID NO:14-20. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a melanoma cell comprises NOT-ADAM29 AND ROR1. In some cases, the ADAM29 polypeptide comprises an amino acid sequence having at least 85%, at least 90%, at least 95%, at least 98%, at least 99%, or 100%, amino acid sequence identity to an amino acid sequence set forth in SEQ ID NO:14-20. In some cases, the ROR1 polypeptide comprises an amino acid sequence having at least 85%, at least 90%, at least 95%, at least 98%, at least 99%, or 100%, amino acid sequence identity to an amino acid sequence set forth in SEQ ID NO:436-437.

In some cases, an antigen combination for targeting a melanoma cell comprises NOT-CDH10 AND MAGEA1. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises NOT-KCNB1 AND B4GALNT1. In some cases, the KCNB1 polypeptide comprises an amino acid sequence having at least 85%, at least 90%, at least 95%, at least 98%, at least 99%, or 100%, amino acid sequence identity to an amino acid sequence set forth in SEQ ID NO:257. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a melanoma cell comprises NOT-NTRK3 AND B4GALNT1. In some cases, the NTRK3 polypeptide comprises an amino acid sequence having at least 85%, at least 90%, at least 95%, at least 98%, at least 99%, or 100%, amino acid sequence identity to an amino acid sequence set forth in SEQ ID NO:388-391. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a melanoma cell comprises NOT-NTRK3 AND ERBB2. In some cases, the NTRK3 polypeptide comprises an amino acid sequence having at least 85%, at least 90%, at least 95%, at least 98%, at least 99%, or 100%, amino acid sequence identity to an amino acid sequence set forth in SEQ ID NO:388-391. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a melanoma cell comprises NOT-SCN4A AND MET. In some cases, the SCN4A polypeptide comprises an amino acid sequence having at least 85%, at least 90%, at least 95%, at least 98%, at least 99%, or 100%, amino acid sequence identity to an amino acid sequence set forth in SEQ ID NO:445. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a melanoma cell comprises NOT-SLC8A3 AND B4GALNT1. In some cases, the SLC8A3 polypeptide comprises an amino acid sequence having at least 85%, at least 90%, at least 95%, at least 98%, at least 99%, or 100%, amino acid sequence identity to an amino acid sequence set forth in SEQ ID NO:497-502. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a melanoma cell comprises NOT-SYT13 AND B4GALNT1. In some cases, the SYT13 polypeptide comprises an amino acid sequence having at least 85%, at least 90%, at least 95%, at least 98%, at least 99%, or 100%, amino acid sequence identity to an amino acid sequence set forth in SEQ ID NO:510-510. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a melanoma cell comprises NOT-TMEM150B AND MET. In some cases, the TMEM150B polypeptide comprises an amino acid sequence having at least 85%, at least 90%, at least 95%, at least 98%, at least 99%, or 100%, amino acid sequence identity to an amino acid sequence set forth in SEQ ID NO:519-520. In some cases, the MET polypeptide comprises an amino acid sequence having at least 85%, at least 90%, at least 95%, at least 98%, at least 99%, or 100%, amino acid sequence identity to an amino acid sequence set forth in SEQ ID NO:313-314.

In some cases, an antigen combination for targeting a melanoma cell comprises NOT-TSPAN1 AND ERBB2. In some cases, the TSPAN1 polypeptide comprises an amino acid sequence having at least 85%, at least 90%, at least 95%, at least 98%, at least 99%, or 100%, amino acid sequence identity to an amino acid sequence set forth in SEQ ID NO:531. In some cases, the ERBB2 polypeptide comprises an amino acid sequence having at least 85%, at least 90%, at least 95%, at least 98%, at least 99%, or 100%, amino acid sequence identity to an amino acid sequence set forth in SEQ ID NO:179-182.

In some cases, an antigen combination for targeting a melanoma cell comprises ADIPOR2 AND MAGEA1. In some cases, the ADIPOR2 polypeptide comprises an amino acid sequence having at least 85%, at least 90%, at least 95%, at least 98%, at least 99%, or 100%, amino acid sequence identity to an amino acid sequence set forth in SEQ ID NO:24. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises BCAP31 AND MAGEA1. In some cases, the BCAP31 polypeptide comprises an amino acid sequence having at least 85%, at least 90%, at least 95%, at least 98%, at least 99%, or 100%, amino acid sequence identity to an amino acid sequence set forth in SEQ ID NO:46-49. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises SLC5A6 AND MAGEA1. In some cases, the SLC5A6 polypeptide comprises an amino acid sequence having at least 85%, at least 90%, at least 95%, at least 98%, at least 99%, or 100%, amino acid sequence identity to an amino acid sequence set forth in SEQ ID NO:492. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises NOT-HTR1E AND MAGEA1. In some cases, the HTR1E polypeptide comprises an amino acid sequence having at least 85%, at least 90%, at least 95%, at least 98%, at least 99%, or 100%, amino acid sequence identity to an amino acid sequence set forth in SEQ ID NO:238. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises NOT-NPFFR1 AND MAGEA1. In some cases, the NPFFR1 polypeptide comprises an amino acid sequence having at least 85%, at least 90%, at least 95%, at least 98%, at least 99%, or 100%, amino acid sequence identity to an amino acid sequence set forth in SEQ ID NO:365. In some cases, the MAGEA1 polypeptide comprises an amino acid sequence having at least 85%, at least 90%, at least 95%, at least 98%, at least 99%, or 100%, amino acid sequence identity to an amino acid sequence set forth in SEQ ID NO:307.

In some cases, an antigen combination for targeting a melanoma cell comprises PMEL AND NOT-ATP1A2. In some cases, the PMEL polypeptide comprises an amino acid sequence having at least 85%, at least 90%, at least 95%, at least 98%, at least 99%, or 100%, amino acid sequence identity to an amino acid sequence set forth in SEQ ID NO:406-410. In some cases, the ATP1A2 polypeptide comprises an amino acid sequence having at least 85%, at least 90%, at least 95%, at least 98%, at least 99%, or 100%, amino acid sequence identity to an amino acid sequence set forth in SEQ ID NO:36.

In some cases, an antigen combination for targeting a melanoma cell comprises PMEL AND NOT-SCN3B. In some cases, the PMEL polypeptide comprises an amino acid sequence having at least 85%, at least 90%, at least 95%, at least 98%, at least 99%, or 100%, amino acid sequence identity to an amino acid sequence set forth in SEQ ID NO:406-410. In some cases, the SCN3B polypeptide comprises an amino acid sequence having at least 85%, at least 90%, at least 95%, at least 98%, at least 99%, or 100%, amino acid sequence identity to an amino acid sequence set forth in SEQ ID NO:443-444.

In some cases, an antigen combination for targeting a melanoma cell comprises PMEL AND NOT-STAB2. In some cases, the PMEL polypeptide comprises an amino acid sequence having at least 85%, at least 90%, at least 95%, at least 98%, at least 99%, or 100%, amino acid sequence identity to an amino acid sequence set forth in SEQ ID NO:406-410. In some cases, the STAB2 polypeptide comprises an amino acid sequence having at least 85%, at least 90%, at least 95%, at least 98%, at least 99%, or 100%, amino acid sequence identity to an amino acid sequence set forth in SEQ ID NO:509.

In some cases, an antigen combination for targeting a melanoma cell comprises PMEL AND NOT-TMEM100. In some cases, the PMEL polypeptide comprises an amino acid sequence having at least 85%, at least 90%, at least 95%, at least 98%, at least 99%, or 100%, amino acid sequence identity to an amino acid sequence set forth in SEQ ID NO:406-410. In some cases, the TMEM100 polypeptide comprises an amino acid sequence having at least 85%, at least 90%, at least 95%, at least 98%, at least 99%, or 100%, amino acid sequence identity to an amino acid sequence set forth in SEQ ID NO:517-518.

Neuroblastoma Target Antigen Combinations

In some cases, an antigen combination for targeting a neuroblastoma cell comprises DIABLO AND B4GALNT1. In some cases, the DIABLO polypeptide comprises an amino acid sequence having at least 85%, at least 90%, at least 95%, at least 98%, at least 99%, or 100%, amino acid sequence identity to an amino acid sequence set forth in SEQ ID NO:157-162. In some cases, the B4GALNT1 polypeptide comprises an amino acid sequence having at least 85%, at least 90%, at least 95%, at least 98%, at least 99%, or 100%, amino acid sequence identity to an amino acid sequence set forth in SEQ ID NO:40-42.

In some cases, an antigen combination for targeting a neuroblastoma cell comprises DIABLO AND DLL3. In some cases, the DIABLO polypeptide comprises an amino acid sequence having at least 85%, at least 90%, at least 95%, at least 98%, at least 99%, or 100%, amino acid sequence identity to an amino acid sequence set forth in SEQ ID NO:157-162. In some cases, the DLL3 polypeptide comprises an amino acid sequence having at least 85%, at least 90%, at least 95%, at least 98%, at least 99%, or 100%, amino acid sequence identity to an amino acid sequence set forth in SEQ ID NO:164-165.

In some cases, an antigen combination for targeting a neuroblastoma cell comprises DIABLO AND GPC3. In some cases, the DIABLO polypeptide comprises an amino acid sequence having at least 85%, at least 90%, at least 95%, at least 98%, at least 99%, or 100%, amino acid sequence identity to an amino acid sequence set forth in SEQ ID NO:157-162. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a neuroblastoma cell comprises DIABLO AND MSLN. In some cases, the DIABLO polypeptide comprises an amino acid sequence having at least 85%, at least 90%, at least 95%, at least 98%, at least 99%, or 100%, amino acid sequence identity to an amino acid sequence set forth in SEQ ID NO:157-162. In some cases, the MSLN polypeptide comprises an amino acid sequence having at least 85%, at least 90%, at least 95%, at least 98%, at least 99%, or 100%, amino acid sequence identity to an amino acid sequence set forth in SEQ ID NO:318-320.

In some cases, an antigen combination for targeting a neuroblastoma cell comprises GPR19 AND KDR. In some cases, the GPR19 polypeptide comprises an amino acid sequence having at least 85%, at least 90%, at least 95%, at least 98%, at least 99%, or 100%, amino acid sequence identity to an amino acid sequence set forth in SEQ ID NO:233. In some cases, the KDR polypeptide comprises an amino acid sequence having at least 85%, at least 90%, at least 95%, at least 98%, at least 99%, or 100%, amino acid sequence identity to an amino acid sequence set forth in SEQ ID NO:274.

In some cases, an antigen combination for targeting a neuroblastoma cell comprises SCN3A AND GPC3. In some cases, the SCN3A polypeptide comprises an amino acid sequence having at least 85%, at least 90%, at least 95%, at least 98%, at least 99%, or 100%, amino acid sequence identity to an amino acid sequence set forth in SEQ ID NO:440-442. In some cases, the GPC3 polypeptide comprises an amino acid sequence having at least 85%, at least 90%, at least 95%, at least 98%, at least 99%, or 100%, amino acid sequence identity to an amino acid sequence set forth in SEQ ID NO:216-218.

In some cases, an antigen combination for targeting a neuroblastoma cell comprises LICAM AND DIABLO. In some cases, the LICAM polypeptide comprises an amino acid sequence having at least 85%, at least 90%, at least 95%, at least 98%, at least 99%, or 100%, amino acid sequence identity to an amino acid sequence set forth in SEQ ID NO:276-279. In some cases, the DIABLO polypeptide comprises an amino acid sequence having at least 85%, at least 90%, at least 95%, at least 98%, at least 99%, or 100%, amino acid sequence identity to an amino acid sequence set forth in SEQ ID NO:157-162.

In some cases, an antigen combination for targeting a neuroblastoma cell comprises LICAM AND NOT-NTRK2. In some cases, the LICAM polypeptide comprises an amino acid sequence having at least 85%, at least 90%, at least 95%, at least 98%, at least 99%, or 100%, amino acid sequence identity to an amino acid sequence set forth in SEQ ID NO:276-279. In some cases, the NTRK2 polypeptide comprises an amino acid sequence having at least 85%, at least 90%, at least 95%, at least 98%, at least 99%, or 100%, amino acid sequence identity to an amino acid sequence set forth in SEQ ID NO:383-387.

Prostate Cancer Target Antigen Combinations

In some cases, an antigen combination for targeting a prostate cancer cell comprises CDH10 AND NRP1. In some cases, the CDH10 polypeptide comprises an amino acid sequence having at least 85%, at least 90%, at least 95%, at least 98%, at least 99%, or 100%, amino acid sequence identity to an amino acid sequence set forth in SEQ ID NO:117. In some cases, the NRP1 polypeptide comprises an amino acid sequence having at least 85%, at least 90%, at least 95%, at least 98%, at least 99%, or 100%, amino acid sequence identity to an amino acid sequence set forth in SEQ ID NO:371-374.

In some cases, an antigen combination for targeting a prostate cancer cell comprises ATP9A AND NRP1. In some cases, the ATP9A polypeptide comprises an amino acid sequence having at least 85%, at least 90%, at least 95%, at least 98%, at least 99%, or 100%, amino acid sequence identity to an amino acid sequence set forth in SEQ ID NO:37. In some cases, the NRP1 polypeptide comprises an amino acid sequence having at least 85%, at least 90%, at least 95%, at least 98%, at least 99%, or 100%, amino acid sequence identity to an amino acid sequence set forth in SEQ ID NO:371-374.

In some cases, an antigen combination for targeting a prostate cancer cell comprises CDH7 AND NRP1. In some cases, the CDH7 polypeptide comprises an amino acid sequence having at least 85%, at least 90%, at least 95%, at least 98%, at least 99%, or 100%, amino acid sequence identity to an amino acid sequence set forth in SEQ ID NO:121-123. In some cases, the NRP1 polypeptide comprises an amino acid sequence having at least 85%, at least 90%, at least 95%, at least 98%, at least 99%, or 100%, amino acid sequence identity to an amino acid sequence set forth in SEQ ID NO:371-374.

In some cases, an antigen combination for targeting a prostate cancer cell comprises TSPAN1 AND NRP1. In some cases, the TSPAN1 polypeptide comprises an amino acid sequence having at least 85%, at least 90%, at least 95%, at least 98%, at least 99%, or 100%, amino acid sequence identity to an amino acid sequence set forth in SEQ ID NO:531. In some cases, the NRP1 polypeptide comprises an amino acid sequence having at least 85%, at least 90%, at least 95%, at least 98%, at least 99%, or 100%, amino acid sequence identity to an amino acid sequence set forth in SEQ ID NO:371-374.

In some cases, an antigen combination for targeting a prostate cancer cell comprises FOLH1 AND NOT-SEMA5A. In some cases, the FOLH1 polypeptide comprises an amino acid sequence having at least 85%, at least 90%, at least 95%, at least 98%, at least 99%, or 100%, amino acid sequence identity to an amino acid sequence set forth in SEQ ID NO:193-197. In some cases, the SEMA5A polypeptide comprises an amino acid sequence having at least 85%, at least 90%, at least 95%, at least 98%, at least 99%, or 100%, amino acid sequence identity to an amino acid sequence set forth in SEQ ID NO:452.

In some cases, an antigen combination for targeting a prostate cancer cell comprises NRP1 AND NOT-RAMP3. In some cases, the NRP1 polypeptide comprises an amino acid sequence having at least 85%, at least 90%, at least 95%, at least 98%, at least 99%, or 100%, amino acid sequence identity to an amino acid sequence set forth in SEQ ID NO:371-374. In some cases, the RAMP3 polypeptide comprises an amino acid sequence having at least 85%, at least 90%, at least 95%, at least 98%, at least 99%, or 100%, amino acid sequence identity to an amino acid sequence set forth in SEQ ID NO:433.

In some cases, an antigen combination for targeting a prostate cancer cell comprises TRPM8 AND NOT-EPHB1. In some cases, the TRPM8 polypeptide comprises an amino acid sequence having at least 85%, at least 90%, at least 95%, at least 98%, at least 99%, or 100%, amino acid sequence identity to an amino acid sequence set forth in SEQ ID NO:530. In some cases, the EPHB1 polypeptide comprises an amino acid sequence having at least 85%, at least 90%, at least 95%, at least 98%, at least 99%, or 100%, amino acid sequence identity to an amino acid sequence set forth in SEQ ID NO:178.

Bone Tumor Target Antigen Combinations

In some cases, an antigen combination for targeting a bone tumor cell comprises NOT-LSR AND LRRC8E. In some cases, the LSR polypeptide comprises an amino acid sequence having at least 85%, at least 90%, at least 95%, at least 98%, at least 99%, or 100%, amino acid sequence identity to an amino acid sequence set forth in SEQ ID NO:302-306. In some cases, the LRRC8E polypeptide comprises an amino acid sequence having at least 85%, at least 90%, at least 95%, at least 98%, at least 99%, or 100%, amino acid sequence identity to an amino acid sequence set forth in SEQ ID NO:298-300.

Methods of Killing Target Cancer Cells

The present disclosure provides methods for inducing an immune response to a target cancer cell and/or killing the target cancer cell. The present disclosure provides a method of inducing an immune response to a target cancer cell and/or killing a target cancer cell in an individual. In some cases, a method of the present disclosure for inducing an immune response to a target cancer cell and/or killing a target cell in an individual comprises: a) introducing a system of the present disclosure into an immune cell (e.g., a $CD8^{+}$ T cell; an NK cell) obtained from the individual, generating a modified immune cell; and b) administering the modified immune cell to the individual, where the modified immune cell kills the target cancer cell in the individual. In some cases, the modified cytotoxic T cell does not substantially kill non-target cells such as non-cancerous cells.

In some cases, a method of the present disclosure for inducing an immune response to a target cancer cell and/or killing a target cell in an individual comprises administering to the individual an effective amount of a polyspecific-immune-inducing polypeptide (PIIP), where such administering may include e.g., delivering (e.g., through injection or other means) the PIIP to the subject, administering to the individual cytotoxic immune cells genetically modified to produce the PIIP, and the like.

The present disclosure provides a method of killing a target cancer cell in an individual. In some cases, a method of the present disclosure for killing a target cell in an individual comprises administering a genetically modified cytotoxic immune cell (e.g., a genetically modified $CD8^{+}$ T cell; a genetically modified NK cell) of the present disclosure to the individual, where the genetically modified immune cell kills the target cancer cell in the individual. In some cases, the modified cytotoxic T cell does not substantially kill non-target cells such as non-cancerous cells.

Where the target antigen pair targeted by a method of the present disclosure is an AND-NOT gate target antigen pair, a method of the present disclosure provides for killing of a target cancer cell, but not a non-cancerous cell. For example, in some cases, a method of the present disclosure provides for a ratio of killing of cancer cells to non-cancerous cells of at least 10:1, at least 15:1, at least 20:1 at least 25:1, at least 50:1, at least 100:1, at least 500:1, at least 103:1, at least 104:1, or at least 105:1.

Where the target antigen pair targeted by a method of the present disclosure is an AND gate target antigen pair, a method of the present disclosure provides for highly specific killing of a target cancer cell, and not a non-target (e.g., non-cancerous cell). For example, in some cases, a method of the present disclosure provides for a ratio of killing of cancer cells to non-cancerous cells of at least 10:1, at least 15:1, at least 20:1 at least 25:1, at least 50:1, at least 100:1, at least 500:1, at least 103:1, at least 104:1, or at least 105:1.

Methods Comprising Use of a System of the Present Disclosure

As noted above, in some cases, a method of the present disclosure for killing a target cell in an individual comprises: a) introducing a system of the present disclosure into an immune cell (e.g., a $CD8^+$ T cell; an NK cell) obtained from the individual, generating a modified immune cell; and b) administering the modified immune cell to the individual, where the modified immune cell kills the target cancer cell in the individual. In some cases, the modified cytotoxic T cell does not substantially kill non-target cells such as non-cancerous cells.

T cells can be obtained from an individual (e.g., an individual having a cancer; an individual diagnosed as having a cancer; an individual being treated for a cancer with chemotherapy, radiation therapy, antibody therapy, surgery, etc.) using well-established methods. In some cases, a mixed population of cells is obtained from an individual; and $CD8^+$ T cells and/or NK cells are isolated from the mixed population, such that a population of $CD8^+$ T cells and/or NK cells is obtained that is at least 75%, at least 80%, at least 85%, at least 90%, at least 95%, or more than 98% pure, i.e., the purified cell population includes less than 25%, less than 20%, less than 15%, less than 10%, less than 5%, or less than 2%, of cells other than $CD8^+$ T cells and or NK cells. A system of the present disclosure is then introduced into the purified $CD8^+$ T cells and/or NK cells, to generate modified $CD8^+$ T cells and/or modified NK cells that express the first antigen-triggered polypeptide and the second antigen-triggered polypeptide.

In some cases, as noted above, a system of the present disclosure comprises: a) a first antigen-triggered polypeptide that binds specifically to a first target antigen present on a target cancer cell; and b) a second antigen-triggered polypeptide that binds specifically to a second target antigen. In these instances, the polypeptides per se are introduced into an immune cell (e.g., $CD8^+$ T cells and/or NK cells obtained from an individual). Methods of introducing polypeptides into a cell are known in the art; and any known method can be used. For example, in some cases, the first and the second antigen-triggered polypeptides comprise a protein transduction domain (PTD) at the N-terminus or the C-terminus of the polypeptides.

In some cases, as noted above, a system of the present disclosure comprises: a) a first nucleic acid comprising a nucleotide sequence encoding a first antigen-triggered polypeptide that binds specifically to a first target antigen present on a target cancer cell; and b) a second nucleic acid comprising a nucleotide sequence encoding a second antigen-triggered polypeptide that binds specifically to a second target antigen. In some cases, the first and the second antigen-triggered polypeptides are encoded by nucleotide sequences on separate nucleic acids. In other cases, the first and the second antigen-triggered polypeptides are encoded by nucleotide sequences present in the same nucleic acid. In some cases, the nucleic acid is a recombinant expression vector. In some cases, a system of the present disclosure comprises: a) a first recombinant expression vector comprising a nucleotide sequence encoding a first antigen-triggered polypeptide that binds specifically to a first target antigen present on a target cancer cell; and b) a second recombinant expression vector comprising a nucleotide sequence encoding a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. In some cases, a system of the present disclosure comprises a recombinant expression vector comprising nucleotide sequences encoding: a) a first antigen-triggered polypeptide that binds specifically to a first target antigen present on a target cancer cell; and b) a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. Suitable promoters include, but are not limited to; cytomegalovirus immediate early promoter; herpes simplex virus thymidine kinase promoter; early and late SV40 promoters; promoter present in long terminal repeats from a retrovirus; a metallothionein-I promoter; and various art-known promoters. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

In some instances, nucleic acids present in a system of the present disclosure include immune cell specific promoters that are expressed in one or more immune cell types, including but not limited to lymphocytes, hematopoietic stem cells and/or progeny thereof (i.e., immune cell progenitors), etc. Any convenient and appropriate promoter of an immune cell specific gene may find use in nucleic acids of the present disclosure. In some instances, an immune cell specific promoter of a nucleic acid present in a system of the present disclosure may be a T cell specific promoter. In some instances, an immune cell specific promoter of a nucleic acid present in a system of the present disclosure may be a light and/or heavy chain immunoglobulin gene promoter and may or may not include one or more related enhancer elements.

In some instances, an immune cell specific promoter of a nucleic acid present in a system of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9γ (TRGV9) gene promoter, a V2δ (TRDV2) gene promoter, and the like.

In some instances, an immune cell specific promoter present in a system of a nucleic acid of the present disclosure may be a viral promoter expressed in immune cells. As such, in some instances, viral promoters useful in nucleic acids present in a system of the present disclosure include viral promoters derived from immune cells viruses, including but not limited to, e.g., lentivirus promoters (e.g., human immunodeficiency virus (HIV), SIV, FIV, EIAV, or Visna promoters) including e.g., long terminal repeat (LTR) promoter, etc., Retroviridae promoters including, e.g., HTLV-I promoter, HTLV-II promoter, etc., and the like.

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) *Proc. Natl. Acad. Sci. USA* 90:7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

Expression vectors generally have convenient restriction sites located near the promoter sequence to provide for the insertion of nucleic acid sequences encoding heterologous proteins. A selectable marker operative in the expression host may be present. Suitable recombinant expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

A method of the present disclosure for killing a target cell in an individual comprising: a) introducing a system of the present disclosure into an immune cell (e.g., a CD8$^+$ T cell; an NK cell) obtained from the individual, generating a modified immune cell; and b) administering the modified immune cell to the individual, where the modified immune cell kills the target cancer cell in the individual, involves administering an effective amount of the modified immune cells to the individual.

In some cases, an effective amount (e.g., an effective number) of agent or modified immune cells is an amount that, when administered in one or more doses to an individual having a cancer, decreases the number of cancer cells in the individual by at least about 10%, at least about 15%, at least about 20%, at least about 25%, at least about 30%, at least about 40%, at least about 50%, at least about 75%, at least about 80%, at least about 90%, at least about 95%, or at least 98%, compared to the number of cancer cells in the individual before said administration.

In some cases, from about $10^2$ to about $10^9$ modified immune cells are administered to an individual in a single dose. In some cases, a single dose of modified immune cells disclosure contains from $10^2$ to about $10^4$, from about $10^4$ to about $10^5$, from about $10^5$ to about $10^6$, from about $10^6$ to about $10^7$, from about $10^7$ to about $10^8$, or from about $10^8$ to about $10^9$ modified immune cells. In some cases, a single dose of modified immune cells is administered. Multiple doses can also be administered, as needed and/or as determined by a medical professional. For example, 2, 3, 4, 5, 6, 7, 8, 9, 10, or more than 10, doses can be administered. If multiple doses are administered, the multiple doses can be administered at various frequencies, including, e.g., once per week, twice per month, once per month, once every 2 months, once every 3 months, once every 4 months, once every 6 months, or once per year.

In some cases, the target cancer cell is an acute myeloid leukemia cell, an anaplastic lymphoma cell, an astrocytoma cell, a B-cell cancer cell, a bone tumor cell, a breast cancer cell, a colon cancer cell, a gastric cancer cell, a glioblastoma cell, a glioma cell, a hepatocellular carcinoma cell, a leiomyosarcoma cell, a liposarcoma cell, a lung cancer cell, a mantle cell lymphoma cell, a melanoma cell, a neuroblastoma cell, a non small cell lung cancer cell, an oligodendroglioma cell, an ovarian cancer cell, a pancreatic cancer cell, a pancreatic ductal carcinoma cell, a prostate cancer cell, a renal cancer cell, a renal cell carcinoma cell, a sarcoma cell, a soft tissue sarcoma cell, a stomach cancer cell, or the like.

Methods Comprising Use of a Genetically Modified Cytotoxic T Cell of the Present Disclosure As noted above, in some cases, a method of the present disclosure for killing a target cell in an individual comprises administering a genetically modified cytotoxic immune cell (e.g., a genetically modified CD8$^+$ T cell; a genetically modified NK cell) of the present disclosure to the individual, where the genetically modified immune cell kills the target cancer cell in the individual. In some cases, the modified cytotoxic T cell does not substantially kill non-target cells such as non-cancerous cells.

T cells can be obtained from an individual (e.g., an individual having a cancer; an individual diagnosed as having a cancer; an individual being treated for a cancer with chemotherapy, radiation therapy, antibody therapy, surgery, etc.) using well-established methods. In some cases, a mixed population of cells is obtained from an individual; and CD8$^+$ T cells and/or NK cells are isolated from the mixed population, such that a population of CD8$^+$ T cells and/or NK cells is obtained that is at least 75%, at least 80%, at least 85%, at least 90%, at least 95%, or more than 98% pure, i.e., the purified cell population includes less than 25%, less than 20%, less than 15%, less than 10%, less than 5%, or less than 2%, of cells other than $CD8^+$ T cells and or NK cells. The purified $CD8^+$ T cells and/or NK cells are then genetically modified to express the first antigen-triggered polypeptide and the second antigen-triggered polypeptide.

A method of the present disclosure for killing a target cell in an individual comprising administering a genetically modified cytotoxic immune cell (e.g., a genetically modified $CD8^+$ T cell; a genetically modified NK cell) of the present disclosure to the individual involves administering an effective amount of a genetically modified cytotoxic immune cell of the present disclosure to the individual.

In some cases, an effective amount (e.g., an effective number) of genetically modified cytotoxic immune cells of the present disclosure is an amount that, when administered in one or more doses to an individual having a cancer, decreases the number of cancer cells in the individual by at least about 10%, at least about 15%, at least about 20%, at least about 25%, at least about 30%, at least about 40%, at least about 50%, at least about 75%, at least about 80%, at least about 90%, at least about 95%, or at least 98%, compared to the number of cancer cells in the individual before said administration.

In some cases, from about $10^2$ to about $10^9$ genetically modified cytotoxic immune cells of the present disclosure are administered to an individual in a single dose. In some cases, a single dose of genetically modified cytotoxic immune cells of the present disclosure contains from $10^2$ to about $10^4$, from about $10^4$ to about $10^5$, from about $10^5$ to about $10^6$, from about $10^6$ to about $10^7$, from about $10^7$ to about $10^8$, or from about $10^8$ to about $10^9$ genetically modified cytotoxic immune cells of the present disclosure. In some cases, a single dose of genetically modified cytotoxic immune cells of the present disclosure is administered. Multiple doses can also be administered, as needed and/or as determined by a medical professional. For example, 2, 3, 4, 5, 6, 7, 8, 9, 10, or more than 10, doses can be administered. If multiple doses are administered, the multiple doses can be administered at various frequencies, including, e.g., once per week, twice per month, once per month, once every 2 months, once every 3 months, once every 4 months, once every 6 months, or once per year.

In some cases, the target cancer cell is an acute myeloid leukemia cell, an anaplastic lymphoma cell, an astrocytoma cell, a B-cell cancer cell, a bone tumor cell, a breast cancer cell, a colon cancer cell, a gastric cancer cell, a glioblastoma cell, a glioma cell, a hepatocellular carcinoma cell, a leiomyosarcoma cell, a liposarcoma cell, a lung cancer cell, a mantle cell lymphoma cell, a melanoma cell, a neuroblastoma cell, a non small cell lung cancer cell, an oligodendroglioma cell, an ovarian cancer cell, a pancreatic cancer cell, a pancreatic ductal carcinoma cell, a prostate cancer cell, a renal cancer cell, a renal cell carcinoma cell, a sarcoma cell, a soft tissue sarcoma cell, a stomach cancer cell, or the like.

Individuals Suitable for Treatment

Individuals suitable for treatment using a method of the present disclosure include an individual having a cancer; an individual diagnosed as having a cancer; an individual being treated for a cancer with chemotherapy, radiation therapy, antibody therapy, surgery, etc.); an individual who has been treated for a cancer (e.g., with one or more of chemotherapy, radiation therapy, antibody therapy, surgery, etc.), and who has failed to respond to the treatment; an individual who has been treated for a cancer (e.g., with one or more of chemotherapy, radiation therapy, antibody therapy, surgery, etc.), and who initially responded to the treatment but who subsequently relapsed, i.e., the cancer recurred.

Cancers that can be treated with a method of the present disclosure include an acute myeloid leukemia, an anaplastic lymphoma, an astrocytoma, a B-cell cancer, a bone tumor, a breast cancer, a colon cancer, a gastric cancer, a glioblastoma, a glioma, a hepatocellular carcinoma, a leiomyosarcoma, a liposarcoma, a lung cancer, a mantle cell lymphoma, a melanoma, a neuroblastoma, a non small cell lung cancer, an oligodendroglioma, an ovarian cancer, a pancreatic cancer, a pancreatic ductal carcinoma, a prostate cancer, a renal cancer, a renal cell carcinoma, a sarcoma, a soft tissue sarcoma, a stomach cancer, or the like.

In some cases, an individual to which a treatment of the present disclosure is administered is an individual expressing one or more antigens relevant to the subject treatment, including e.g., one or more (including 2 or more) target (i.e., cancer) antigens and/or one or more non-target (i.e., non-cancer or normal) antigens. Antigen expression may be determined by any convenient means. For example, in some instances, a subject may be evaluated for expression (or lack thereof) of one or more antigens relevant to the subject treatment, including one or more or all of the antigens of a particular antigen combination utilized in the treatment. Such evaluations (i.e., antigen expression testing) may be performed at any convenient time before, during or after a particular treatment regimen and using any convenient sample obtained from a subject (e.g., a tissue sample, a biopsy sample, etc.). Evaluations of antigen expression may be employed predictively (e.g., to predict the efficacy of an antigen combination based therapy), concurrently (e.g., to confirm the expression of antigens of an antigen combination during therapy), retrospectively (e.g., to analyze the expression of antigens of an antigen combination after therapy, e.g., to correlate expression of treatment outcomes, e.g., as part of a clinical trial utilizing an antigen combination described herein), or the like.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered as below are provided. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. An in vitro or ex vivo genetically modified cytotoxic immune cell, wherein the cytotoxic immune cell is genetically modified to produce two different polypeptides that recognize two different cell surface antigens, wherein at least one of the two different cell surface antigens is present on the surface of a target cancer cell and the two different cell surface antigens are selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EPHA2, NRCAM and ERBB2, NRCAM and IL13RA2, CLDN15 and GPC3, MET and TPBG, CDH6 and CA9, CSF3R and CD70, CADM1 and CD70, HEG1 and MUC1, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, GPR1 and EGFR, KCNJ5 and EGFR, LIFR and FAP, PCDH9 and EGFR, SLC46A1 and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, FXYD3 and EPCAM, BAMBI and B4GALNT1, C11orf24 and KDR, GPR19 and ERBB2, ST3GAL5 and FAP, TNFSF9 and MET, ADAM29 and MET, ADAM29 and ROR1, KCNB1 and B4GALNT1, NTRK3 and B4GALNT1, NTRK3 and ERBB2, SCN4A and MET, SLC8A3 and B4GALNT1, SYT13 and B4GALNT1, TMEM150B and MET, TSPAN1 and ERBB2, DIABLO and B4GALNT1, DIABLO and DLL3, DIABLO and GPC3, DIABLO and MSLN, SCN3A and GPC3, ADAM12 and CD80, ADAM12 and CD86, IL2RA and EGFR, KISS1R and EGFR, ADCY4 and CD274, CADM3 and EGFR, CD101 and CD274, CD36 and CD274, CYP4F12 and EGFR, MAL and CD274, TMEM17 and GPC3, ITGB8 and FOLR1, KCNA6 and FOLR1, KCNK15 and FOLR1, PTH2R and FOLR1, RET and FOLR1, LRRTM1 and CDH10, GP2 and MSLN, GP2 and PSCA, KCNE4 and CLDN18, NOX4 and PSCA, PPAPDC1A and PSCA, TNFSF4 and CLDN18, TREM2 and PSCA, CLDN18 and MAL, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, AXL and PDGFRA, CD70 and ADRB2, CD99 and B4GALNT1, CDH11 and B4GALNT1, HTRA2 and B4GALNT1, ATP13A4 and ROR1, Clorf210 and ERBB2, Clorf210 and ROR1, CDH1 and ROR1, ITGB6 and ERBB2, LSR and ERBB2, SCNN1A and ERBB2, SLC26A9 and ROR1, SLC2A12 and ERBB2, SLC6A14 and ROR1, NRCAM and PROM1, NRCAM and TSPAN11, ALDH1A1 and IL3RA, HEG1 and IL3RA, TGFBR3 and IL3RA, WLS and IL3RA, WLS and PROM1, LSR and LRRC8E, CLDN2 and DLL4, CXCL9 and DLL4, F2RL2 and DLL4, MUC13 and DKK1, VSIG1 and DLL4, CRB1 and IGFLR1, CRB1 and PROM1, NLGN4X and PROM1, SLC1A3 and PROM1, AFP and ALCAM, AFP and CNNM3, AFP and ERBB3, AFP and LRRC8D, AFP and SLC38A6, SLC17A2 and CLEC4M, ADIPOR2 and MAGEA1, BCAP31 and MAGEA1, SLC5A6 and MAGEA1, HTR1E and MAGEA1, NPFFR1 and MAGEA1, PMEL and ATP1A2, PMEL and SCN3B, PMEL and STAB2, PMEL and TMEM100, L1CAM and DIABLO, L1CAM and NTRK2, CD80 and GPM6A, CD86 and CD33, CD36 and CD86, GPBAR1 and CD86, P2RX1 and CD86, SEZ6 and CD80, SLC13A4 and CD80, SLC6A4 and CD80, LRRTM1 and SLC28A3, LRRTM1 and VTCN1, PIRT and VTCN1, SSX1 and VTCN1, CLCNKB and SLC22A2, LRRTM1 and SCN4B, NOX4 and CEACAM6, ATP9A and NRP1, CDH7 and NRP1, TSPAN1 and NRP1, FOLH1 and SEMA5A, NRP1 and RAMP3, TRPM8 and EPHB1, CLDN2 and PCDHB10, ENPEP and ROR2, ENPP3 and ROR2, EPHA7 and SLCO4C1, MAGT1 and ROR2, SLC3A1 and ROR2, GPM6B and ROR2, SLC22A2 and KCNJ1, LINGO1 and NALCN, THY1 and NDRG4, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and IL13RA2, PTPRZ1 and EPHA2, PTPRZ1 and B4GALNT1, PTPRZ1 and ERBB2, BCAN and IL13RA2, BCAN and GPC3, BCAN and ROR1, BCAN and B4GALNT1, BCAN and ERBB2, MLC1 and IL13RA2, MLC1 and DLL3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and DLL3, AQP4 and EPHA2, AQP4 and GPC3, AQP4 and MSLN, AQP4 and ROR1, AQP4 and MUC1, and AQP4 and ERBB2.

2. The genetically modified cytotoxic immune cell of aspect 1, wherein the target cancer cell is a breast cancer cell and the two different cell surface antigens are selected from: FAP and CLDN3, PMEPA1 and ERBB2, PMEPA1 and MSLN, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, and TNFSF4 and MET.

3. The genetically modified cytotoxic immune cell of aspect 1, wherein the target cancer cell is a glioblastoma cancer cell and the two different cell surface antigens are selected from: PTPRZ1 and IL13RA2, CA9 and IL13RA2, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and DLL3, PTPRZ1 and EPHA2, PTPRZ1 and GPC3, PTPRZ1 and MSLN, PTPRZ1 and ROR1, PTPRZ1 and B4GALNT1, PTPRZ1 and ERBB2, BCAN and IL13RA2, BCAN and DLL3, BCAN and EPHA2, BCAN and GPC3, BCAN and MSLN, BCAN and ROR1, BCAN and EGFR, BCAN and MUC1, BCAN and B4GALNT1, BCAN and ERBB2, MLC1 and IL13RA2, MLC1 and DLL3, MLC1 and EPHA2, MLC1 and GPC3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NLGN3 and B4GALNT1, NLGN3 and ERBB2, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and IL13RA2, AQP4 and DLL3, AQP4 and EPHA2, AQP4 and GPC3, AQP4 and MSLN, AQP4 and ROR1, AQP4 and MUC1, AQP4 and B4GALNT1, AQP4 and ERBB2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, and CRB1 and IGFLR1.

4. The genetically modified cytotoxic immune cell of aspect 1, wherein the target cancer cell is a glioma cancer cell and the two different cell surface antigens are selected from: CDH10 and KDR, CDH10 and ROR1, PTPRZ1 and DLL3, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, NRCAM and PROM1, NRCAM and TSPAN11, CRB1 and PROM1, NLGN4X and PROM1, and SLC1A3 and PROM1.

5. The genetically modified cytotoxic immune cell of aspect 1, wherein the target cancer cell is a non-small cell lung cancer (NSCLC) cancer cell and the two different cell surface antigens are selected from: FAP and CD274, FCRL5 and EGFR, ADAM12 and CD80, ADAM12 and CD86, IL2RA and EGFR, KISS1R and EGFR, ADCY4 and CD274, CADM3 and EGFR, CD101 and CD274, CD36 and CD274, CYP4F12 and EGFR, MAL and CD274, TMEM17 and GPC3, CD80 and GPM6A, CD86 and CD33, CD36 and CD86, GPBAR1 and CD86, P2RX1 and CD86, SEZ6 and CD80, SLC13A4 and CD80, and SLC6A4 and CD80.

6. The genetically modified cytotoxic immune cell of aspect 5, wherein the two different cell surface antigens are present on the surface of the NSCLC target cancer cell and the two different antigens are selected from: FAP and CD274, FCRL5 and EGFR, ADAM12 and CD80, ADAM12 and CD86, IL2RA and EGFR, and KISS1R and EGFR.

7. The genetically modified cytotoxic immune cell of aspect 5, wherein the cytotoxic immune cell: a) is activated to kill a NSCLC target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: CD274 and ADCY4, EGFR and CADM3, CD274 and CD101, CD274 and CD36, EGFR and CYP4F12, CD274 and MAL, GPC3 and TMEM17, CD80 and GPM6A, CD86 and CD33, CD86 and CD36, CD86 and GPBAR1, CD86 and P2RX1, CD80 and SEZ6, CD80 and SLC13A4, or CD80 and SLC6A4.

8. The genetically modified cytotoxic immune cell of aspect 1, wherein the target cancer cell is an ovarian cancer cell and the two different cell surface antigens are selected from: MSLN and FAP, ITGB8 and FOLR1, KCNA6 and FOLR1, KCNK15 and FOLR1, PTH2R and FOLR1, RET and FOLR1, LRRTM1 and CDH10, LRRTM1 and SLC28A3, LRRTM1 and VTCN1, PIRT and VTCN1, SSX1 and VTCN1, CLCNKB and SLC22A2, and LRRTM1 and SCN4B.

9. The genetically modified cytotoxic immune cell of aspect 8, wherein the two different cell surface antigens are present on the surface of the ovarian target cancer cell and the two different antigens are selected from: MSLN and FAP, ITGB8 and FOLR1, KCNA6 and FOLR1, KCNK15 and FOLR1, PTH2R and FOLR1, RET and FOLR1, LRRTM1 and SLC28A3, LRRTM1 and VTCN1, PIRT and VTCN1, and SSX1 and VTCN1.

10. The genetically modified cytotoxic immune cell of aspect 8, wherein the cytotoxic immune cell: a) is activated to kill an ovarian target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: LRRTM1 and CDH10, CLCNKB and SLC22A2, or LRRTM1 and SCN4B.

11. The genetically modified cytotoxic immune cell of aspect 1, wherein the target cancer cell is a pancreatic ductal carcinoma cancer cell and the two different cell surface antigens are selected from: FAP and PSCA, GP2 and MSLN, GP2 and PSCA, KCNE4 and CLDN18, NOX4 and PSCA, PPAPDC1A and PSCA, TNFSF4 and CLDN18, TREM2 and PSCA, CLDN18 and MAL, and NOX4 and CEACAM6.

12. The genetically modified cytotoxic immune cell of aspect 11, wherein the two different cell surface antigens are present on the surface of the pancreatic ductal carcinoma target cancer cell and the two different antigens are selected from: FAP and PSCA, GP2 and MSLN, GP2 and PSCA, KCNE4 and CLDN18, NOX4 and PSCA, PPAPDC1A and PSCA, TNFSF4 and CLDN18, TREM2 and PSCA, and NOX4 and CEACAM6.

13. The genetically modified cytotoxic immune cell of aspect 11, wherein the cytotoxic immune cell: a) is activated to kill a pancreatic ductal carcinoma target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: CLDN18 and MAL.

14. The genetically modified cytotoxic immune cell of aspect 1, wherein the target cancer cell is a renal cell carcinoma (RCC) cancer cell and the two different cell surface antigens are selected from: CD70 and CA9, CD70 and FOLR1, CDH6 and CA9, KCNJ16 and AXL, LRP2 and AXL, LRP2 and CA9, SLC16A4 and AXL, SLC3A1 and AXL, SLC3A1 and CA9, TMEM27 and CA9, AXL and PDGFRA, CD70 and ADRB2, CLDN2 and PCDHB10, ENPEP and ROR2, ENPP3 and ROR2, EPHA7 and SLCO4C1, MAGT1 and ROR2, SLC3A1 and ROR2, GPM6B and ROR2, SLC22A2 and CLCNKB, and SLC22A2 and KCNJ1.

15. The genetically modified cytotoxic immune cell of aspect 14, wherein the two different cell surface antigens are present on the surface of the RCC target cancer cell and the two different antigens are selected from: CD70 and CA9, CD70 and FOLR1, CDH6 and CA9, KCNJ16 and AXL, LRP2 and AXL, LRP2 and CA9, SLC16A4 and AXL, SLC3A1 and AXL, SLC3A1 and CA9, TMEM27 and CA9, CLDN2 and PCDHB10, ENPEP and ROR2, ENPP3 and ROR2, EPHA7 and SLCO4C1, MAGT1 and ROR2, and SLC3A1 and ROR2.

16. The genetically modified cytotoxic immune cell of aspect 14, wherein the cytotoxic immune cell: a) is activated to kill a RCC target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: AXL and PDGFRA, CD70 and ADRB2, ROR2 and GPM6B, SLC22A2 and CLCNKB, or SLC22A2 and KCNJ1.

17. The genetically modified cytotoxic immune cell of aspect 1, wherein the target cancer cell is a soft tissue sarcoma cancer cell and the two different cell surface antigens are selected from: BIRC5 and B4GALNT1, CD99 and B4GALNT1, CDH11 and B4GALNT1, HTRA2 and B4GALNT1, ATP13A4 and ROR1, Clorf210 and ERBB2, Clorf210 and ROR1, CDH1 and ROR1, ITGB6 and ERBB2, LSR and ERBB2, SCNN1A and ERBB2, SLC26A9 and ROR1, SLC2A12 and ERBB2, SLC6A14 and ROR1, LINGO1 and NALCN, and THY1 and NDRG4.

18. The genetically modified cytotoxic immune cell of aspect 17, wherein the two different cell surface antigens are present on the surface of the soft tissue sarcoma target cancer cell and the two different antigens are selected from: BIRC5 and B4GALNT1, CD99 and B4GALNT1, CDH11 and B4GALNT1, and HTRA2 and B4GALNT1.

19. The genetically modified cytotoxic immune cell of aspect 17, wherein the cytotoxic immune cell: a) is activated to kill a soft tissue sarcoma target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: ROR1 and ATP13A4, ERBB2 and Clorf210, ROR1 and Clorf210, ROR1 and CDH1, ERBB2 and ITGB6, ERBB2 and LSR, ERBB2 and SCNN1A, ROR1 and SLC26A9, ERBB2 and SLC2A12, ROR1 and SLC6A14, LINGO1 and NALCN, or THY1 and NDRG4.

20. The genetically modified cytotoxic immune cell of aspect 1, wherein the target cancer cell is a hepatocellular carcinoma (HCC) cancer cell and the two different cell surface antigens are selected from: CLDN15 and GPC3, MET and TPBG, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, FXYD3 and EPCAM, AFP and ALCAM, AFP and CNNM3, AFP and ERBB3, AFP and LRRC8D, AFP and SLC38A6, and SLC17A2 and CLEC4M.

21. The genetically modified cytotoxic immune cell of aspect 20, wherein the two different cell surface antigens are present on the surface of the HCC target cancer cell and the two different antigens are selected from: CLDN15 and GPC3, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, FXYD3 and EPCAM, AFP and ALCAM, AFP and CNNM3, AFP and ERBB3, AFP and LRRC8D, and AFP and SLC38A6.

22. The genetically modified cytotoxic immune cell of aspect 20, wherein the cytotoxic immune cell: a) is activated to kill a HCC target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: MET and TPBG, EPCAM and FXYD3, or SLC17A2 and CLEC4M.

23. The genetically modified cytotoxic immune cell of aspect 1, wherein the target cancer cell is a Acute Myeloid Leukemia (AML) cancer cell and the two different cell surface antigens are selected from: CSF3R and CD70, CADM1 and CD70, HEG1 and MUC1, ALDH1A1 and IL3RA, HEG1 and IL3RA, TGFBR3 and IL3RA, WLS and IL3RA, and WLS and PROM1.

24. The genetically modified cytotoxic immune cell of aspect 23, wherein the two different cell surface antigens are present on the surface of the AML target cancer cell and the two different antigens are CSF3R and CD70.

25. The genetically modified cytotoxic immune cell of aspect 23, wherein the cytotoxic immune cell: a) is activated to kill a AML target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: CD70 and CADM1, MUC1 and HEG1, IL3RA and ALDH1A1, IL3RA and HEG1, IL3RA and TGFBR3, IL3RA and WLS, or PROM1 and WLS.

26. The genetically modified cytotoxic immune cell of aspect 1, wherein the target cancer cell is a colon cancer cell and the two different cell surface antigens are selected from: AMIGO2 and CEACAM5, BFAR and EGFR, GPR1 and EGFR, KCNJ5 and EGFR, LIFR and FAP, PCDH9 and EGFR, and SLC46A1 and EGFR.

27. The genetically modified cytotoxic immune cell of aspect 26, wherein the two different cell surface antigens are present on the surface of the colon cancer target cancer cell and the two different antigens are selected from: AMIGO2 and CEACAM5, and BFAR and EGFR.
28. The genetically modified cytotoxic immune cell of aspect 26, wherein the cytotoxic immune cell: a) is activated to kill a colon cancer target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: EGFR and GPR1, EGFR and KCNJ5, FAP and LIFR, EGFR and PCDH9, or EGFR and SLC46A1.
29. The genetically modified cytotoxic immune cell of aspect 1, wherein the target cancer cell is a gastric cancer cell and the two different cell surface antigens are selected from: PSCA and DLL4, CLDN2 and DLL4, CXCL9 and DLL4, F2RL2 and DLL4, MUC13 and DKK1, and VSIG1 and DLL4.
30. The genetically modified cytotoxic immune cell of aspect 1, wherein the target cancer cell is a melanoma cancer cell and the two different cell surface antigens are selected from: BAMBI and B4GALNT1, C11orf24 and KDR, GPR19 and ERBB2, ST3GAL5 and FAP, TNFSF9 and MET, ADAM29 and MET, ADAM29 and ROR1, CDH10 and MAGEA1, KCNB1 and B4GALNT1, NTRK3 and B4GALNT1, NTRK3 and ERBB2, SCN4A and MET, SLC8A3 and B4GALNT1, SYT13 and B4GALNT1, TMEM150B and MET, TSPAN1 and ERBB2, ADIPOR2 and MAGEA1, BCAP31 and MAGEA1, SLC5A6 and MAGEA1, HTR1E and MAGEA1, NPFFR1 and MAGEA1, PMEL and ATP1A2, PMEL and SCN3B, PMEL and STAB2, and PMEL and TMEM100.
31. The genetically modified cytotoxic immune cell of aspect 30, wherein the two different cell surface antigens are present on the surface of the melanoma target cancer cell and the two different antigens are selected from: BAMBI and B4GALNT1, C11orf24 and KDR, GPR19 and ERBB2, ST3GAL5 and FAP, TNFSF9 and MET, ADIPOR2 and MAGEA1, BCAP31 and MAGEA1, and SLC5A6 and MAGEA1.
32. The genetically modified cytotoxic immune cell of aspect 30, wherein the cytotoxic immune cell: a) is activated to kill a melanoma target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: MET and ADAM29, ROR1 and ADAM29, MAGEA1 and CDH10, B4GALNT1 and KCNB1, B4GALNT1 and NTRK3, ERBB2 and NTRK3, MET and SCN4A, B4GALNT1 and SLC8A3, B4GALNT1 and SYT13, MET and TMEM150B, ERBB2 and TSPAN1, MAGEA1 and HTR1E, MAGEA1 and NPFFR1, PMEL and ATP1A2, PMEL and SCN3B, PMEL and STAB2, or PMEL and TMEM100.
33. The genetically modified cytotoxic immune cell of aspect 1, wherein the target cancer cell is a neuroblastoma cancer cell and the two different cell surface antigens are selected from: DIABLO and B4GALNT1, DIABLO and DLL3, DIABLO and GPC3, DIABLO and MSLN, GPR19 and KDR, SCN3A and GPC3, LlCAM and DIABLO, and LlCAM and NTRK2.
34. The genetically modified cytotoxic immune cell of aspect 33, wherein the two different cell surface antigens are present on the surface of the neuroblastoma target cancer cell and the two different antigens are selected from: DIABLO and B4GALNT1, DIABLO and DLL3, DIABLO and GPC3, DIABLO and MSLN, GPR19 and KDR, SCN3A and GPC3, and LlCAM and DIABLO.
35. The genetically modified cytotoxic immune cell of aspect 33, wherein the cytotoxic immune cell: a) is activated to kill a neuroblastoma target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: LlCAM and NTRK2.
36. The genetically modified cytotoxic immune cell of aspect 1, wherein the target cancer cell is a prostate cancer cell and the two different cell surface antigens are selected from: CDH10 and NRP1, ATP9A and NRP1, CDH7 and NRP1, TSPAN1 and NRP1, FOLH1 and SEMA5A, NRP1 and RAMP3, and TRPM8 and EPHB1.
37. The genetically modified cytotoxic immune cell of aspect 36, wherein the two different cell surface antigens are present on the surface of the prostate cancer target cancer cell and the two different antigens are selected from: CDH10 and NRP1, ATP9A and NRP1, CDH7 and NRP1, and TSPAN1 and NRP1.
38. The genetically modified cytotoxic immune cell of aspect 36, wherein the cytotoxic immune cell: a) is activated to kill a prostate cancer target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: FOLH1 and SEMA5A, NRP1 and RAMP3, or TRPM8 and EPHB1.
39. The genetically modified cytotoxic immune cell of aspect 1, wherein the target cancer cell is a bone cancer cell and the two different cell surface antigens are LRRC8E and LSR.
40. The genetically modified cytotoxic immune cell of aspect 39, wherein the cytotoxic immune cell: a) is activated to kill a bone cancer target cancer cell that expresses the first target cell surface antigen, but not the second target cell surface antigen, on its cell surface; and b) is inhibited from killing a non-cancerous cell when the non-cancerous cell expresses both the first target cell surface antigen and the second target cell surface antigen on its cell surface, wherein the first and second target cell surface antigens are, respectively: LRRC8E and LSR.
41. The genetically modified cytotoxic immune cell of any of the preceding aspects, wherein the cytotoxic immune cell is a cytotoxic T cell or a natural killer cell.

42. The genetically modified cytotoxic immune cell of any of the preceding aspects, wherein the two different polypeptides are antigen-triggered polypeptides selected from the group consisting of: a binding-triggered transcriptional switch (BTTS) and a chimeric antigen receptor (CAR), a BTTS and a T cell receptor (TCR), a CAR and an inhibitory CAR (iCAR), and a first BTTS and a second BTTS.
43. The genetically modified cytotoxic immune cell of aspect 42, wherein the BTTS is a synNotch receptor or a chimeric polypeptide comprising a non-Notch force sensor cleavage domain.
44. A method of killing a target cancer cell in an individual, the method comprising administering to the individual an effective number of the genetically modified cytotoxic immune cell of any one of aspects 1-43, wherein said genetically modified cytotoxic immune cell kills the target cancer cell in the individual.
45. A system for killing a target cancer cell, the system comprising: a) a first antigen-triggered polypeptide that binds specifically to a first target antigen, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide, wherein at least one of the first or second target antigens is present on the target cancer cell and the first and second target antigens are selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EPHA2, NRCAM and ERBB2, NRCAM and IL13RA2, CLDN15 and GPC3, MET and TPBG, CDH6 and CA9, CSF3R and CD70, CADM1 and CD70, HEG1 and MUC1, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, GPR1 and EGFR, KCNJ5 and EGFR, LIFR and FAP, PCDH9 and EGFR, SLC46A1 and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, FXYD3 and EPCAM, BAMBI and B4GALNT1, C11orf24 and KDR, GPR19 and ERBB2, ST3GAL5 and FAP, TNFSF9 and MET, ADAM29 and MET, ADAM29 and ROR1, KCNB1 and B4GALNT1, NTRK3 and B4GALNT1, NTRK3 and ERBB2, SCN4A and MET, SLC8A3 and B4GALNT1, SYT13 and B4GALNT1, TMEM150B and MET, TSPAN1 and ERBB2, DIABLO and B4GALNT1, DIABLO and DLL3, DIABLO and GPC3, DIABLO and MSLN, SCN3A and GPC3, ADAM12 and CD80, ADAM12 and CD86, IL2RA and EGFR, KISS1R and EGFR, ADCY4 and CD274, CADM3 and EGFR, CD101 and CD274, CD36 and CD274, CYP4F12 and EGFR, MAL and CD274, TMEM17 and GPC3, ITGB8 and FOLR1, KCNA6 and FOLR1, KCNK15 and FOLR1, PTH2R and FOLR1, RET and FOLR1, LRRTM1 and CDH10, GP2 and MSLN, GP2 and PSCA, KCNE4 and CLDN18, NOX4 and PSCA, PPAPDC1A and PSCA, TNFSF4 and CLDN18, TREM2 and PSCA, CLDN18 and MAL, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, AXL and PDGFRA, CD70 and ADRB2, CD99 and B4GALNT1, CDH11 and B4GALNT1, HTRA2 and B4GALNT1, ATP13A4 and ROR1, Clorf210 and ERBB2, Clorf210 and ROR1, CDH1 and ROR1, ITGB6 and ERBB2, LSR and ERBB2, SCNN1A and ERBB2, SLC26A9 and ROR1, SLC2A12 and ERBB2, SLC6A14 and ROR1, NRCAM and PROM1, NRCAM and TSPAN11, ALDH1A1 and IL3RA, HEG1 and IL3RA, TGFBR3 and IL3RA, WLS and IL3RA, WLS and PROM1, LSR and LRRC8E, CLDN2 and DLL4, CXCL9 and DLL4, F2RL2 and DLL4, MUC13 and DKK1, VSIG1 and DLL4, CRB1 and IGFLR1, CRB1 and PROM1, NLGN4X and PROM1, SLC1A3 and PROM1, AFP and ALCAM, AFP and CNNM3, AFP and ERBB3, AFP and LRRC8D, AFP and SLC38A6, SLC17A2 and CLEC4M, ADIPOR2 and MAGEA1, BCAP31 and MAGEA1, SLC5A6 and MAGEA1, HTR1E and MAGEA1, NPFFR1 and MAGEA1, PMEL and ATP1A2, PMEL and SCN3B, PMEL and STAB2, PMEL and TMEM100, LlCAM and DIABLO, LlCAM and NTRK2, CD80 and GPM6A, CD86 and CD33, CD36 and CD86, GPBAR1 and CD86, P2RX1 and CD86, SEZ6 and CD80, SLC13A4 and CD80, SLC6A4 and CD80, LRRTM1 and SLC28A3, LRRTM1 and VTCN1, PIRT and VTCN1, SSX1 and VTCN1, CLCNKB and SLC22A2, LRRTM1 and SCN4B, NOX4 and CEACAM6, ATP9A and NRP1, CDH7 and NRP1, TSPAN1 and NRP1, FOLH1 and SEMA5A, NRP1 and RAMP3, TRPM8 and EPHB1, CLDN2 and PCDHB10, ENPEP and ROR2, ENPP3 and ROR2, EPHA7 and SLCO4C1, MAGT1 and ROR2, SLC3A1 and ROR2, GPM6B and ROR2, SLC22A2 and KCNJ1, LINGO1 and NALCN, THY1 and NDRG4, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and IL13RA2, PTPRZ1 and EPHA2, PTPRZ1 and B4GALNT1, PTPRZ1 and ERBB2, BCAN and IL13RA2, BCAN and GPC3, BCAN and ROR1, BCAN and B4GALNT1, BCAN and ERBB2, MLC1 and IL13RA2, MLC1 and DLL3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and DLL3, AQP4 and EPHA2, AQP4 and GPC3, AQP4 and MSLN, AQP4 and ROR1, AQP4 and MUC1, and AQP4 and ERBB2.

46. The system of aspect 45, wherein the first antigen-triggered polypeptide is a binding-triggered transcriptional switch (BTTS), and the second antigen-triggered polypeptide is a chimeric antigen receptor (CAR).

47. The system of aspect 45, wherein the first antigen-triggered polypeptide is a binding-triggered transcriptional switch (BTTS), and the second antigen-triggered polypeptide is an inhibitory CAR (iCAR).

48. The system of aspect 45, wherein: a) the first antigen-triggered polypeptide is a binding-triggered transcriptional switch (BTTS), and the second antigen-triggered polypeptide is one polypeptide chain of a split CAR; b) the first antigen-triggered polypeptide is a BTTS, and the second antigen-triggered polypeptide is a T-cell receptor; c) the first antigen-triggered polypeptide is a BTTS, and the second antigen-triggered polypeptide is an immunoinhibitory polypeptide; or d) the first antigen-triggered polypeptide is a first BTTS, and the second antigen-triggered polypeptide is a second BTTS.

49. The system of any of aspects 46-48, wherein the BTTS is a synNotch receptor or a chimeric polypeptide comprising a non-Notch force sensor cleavage domain.

50. The system of aspect 45, wherein the first target antigen and the second target antigen are both present on the surface of a target cancer cell.

51. The system of aspect 45, wherein: a) the first target antigen and the second target antigen are both present on the surface of a non-cancerous cell; and b) wherein the first target antigen, but not the second target antigen, is present on the surface of a target cancer cell.

52. A method of killing a target cancer cell in an individual, the method comprising: a) introducing the system of any one of aspects 45-51 into a cytotoxic T cell in vitro or ex vivo, generating a modified cytotoxic T cell; and b) administering the modified cytotoxic T cell to the individual.

53. A polyspecific-immune-inducing polypeptide (PIIP) comprising: a first antigen binding domain specific for a first antigen present on the surface of a target cancer cell and a second antigen binding domain specific for a second antigen present on the surface of the target cancer cell, wherein the first and second antigens are selected from: PTPRZ1 and IL13RA2, FAP and CLDN3, CA9 and IL13RA2, PTPRZ1 and DLL3, PTPRZ1 and EPHA2, PTPRZ1 and GPC3, PTPRZ1 and MSLN, PTPRZ1 and ROR1, CDH10 and KDR, CDH10 and ROR1, FAP and CD274, FCRL5 and EGFR, MSLN and FAP, FAP and PSCA, CD70 and CA9, CD70 and FOLR1, BIRC5 and B4GALNT1, PMEPA1 and ERBB2, PMEPA1 and MSLN, BCAN and DLL3, BCAN and EGFR, BCAN and EPHA2, BCAN and MSLN, BCAN and MUC1, MLC1 and EPHA2, MLC1 and GPC3, NLGN3 and B4GALNT1, NLGN3 and ERBB2, NRCAM and EGFR, NRCAM and EPHA2, NRCAM and ERBB2, NRCAM and IL13RA2, CLDN15 and GPC3, CDH6 and CA9, CSF3R and CD70, CCR5 and MET, CD84 and MET, CXCL9 and ERBB2, KCNK15 and MSLN, LPAR2 and MET, SLC38A1 and MET, SLC5A6 and ERBB2, SLC5A6 and MSLN, TNFSF4 and MET, AMIGO2 and CEACAM5, BFAR and EGFR, PSCA and DLL4, AQP4 and B4GALNT1, AQP4 and IL13RA2, B4GALNT1 and ADAM17, BEST3 and IL13RA2, CDH10 and F2R, CDH10 and MMP14, CRB1 and EGFR, CRB1 and EPHA2, GPM6A and GPC3, GRIK5 and ERBB2, ITGB8 and IL13RA2, NLGN4X and EGFR, NRSN2 and ERBB2, PDPN and B4GALNT1, SEMA5B and ERBB2, SLC6A1 and MUC1, TTYH3 and B4GALNT1, CDH10 and MAGEA1, GPM6A and ERBB2, GPM6A and KDR, GPM6A and ROR1, GPR19 and KDR, GPR19 and MSLN, GPR19 and ROR1, NLGN1 and DLL3, SLC1A3 and MSLN, ABCC6 and GPC3, ACSL6 and EPCAM, C1QTNF1 and EPCAM, GPR88 and EPCAM, PAQR9 and EPCAM, SLC2A2 and GPC3, SLC30A10 and GPC3, SLCO1B1 and GPC3, BAMBI and B4GALNT1, C11orf24 and KDR, GPR19 and ERBB2, ST3GAL5 and FAP, TNFSF9 and MET, DIABLO and B4GALNT1, DIABLO and DLL3, DIABLO and GPC3, DIABLO and MSLN, SCN3A and GPC3, ADAM12 and CD80, ADAM12 and CD86, IL2RA and EGFR, KISS1R and EGFR, ITGB8 and FOLR1, KCNA6 and FOLR1, KCNK15 and FOLR1, PTH2R and FOLR1, RET and FOLR1, GP2 and MSLN, GP2 and PSCA, KCNE4 and CLDN18, NOX4 and PSCA, PPAPDC1A and PSCA, TNFSF4 and CLDN18, TREM2 and PSCA, CDH10 and NRP1, KCNJ16 and AXL, LRP2 and AXL, LRP2 and CA9, SLC16A4 and AXL, SLC3A1 and AXL, SLC3A1 and CA9, TMEM27 and CA9, CD99 and B4GALNT1, CDH11 and B4GALNT1, HTRA2 and B4GALNT1, NRCAM and PROM1, NRCAM and TSPAN11, CLDN2 and DLL4, CXCL9 and DLL4, F2RL2 and DLL4, MUC13 and DKK1, VSIG1 and DLL4, CRB1 and IGFLR1, CRB1 and PROM1, NLGN4X and PROM1, SLC1A3 and PROM1, AFP and ALCAM, AFP and CNNM3, AFP and ERBB3, AFP and LRRC8D, AFP and SLC38A6, ADIPOR2 and MAGEA1, BCAP31 and MAGEA1, SLC5A6 and MAGEA1, LlCAM and DIABLO, LRRTM1 and SLC28A3, LRRTM1 and VTCN1, PIRT and VTCN1, SSX1 and VTCN1, NOX4 and CEACAM6, ATP9A and NRP1, CDH7 and NRP1, TSPAN1 and NRP1, CLDN2 and PCDHB10, ENPEP and ROR2, ENPP3 and ROR2, EPHA7 and SLCO4C1, MAGT1 and ROR2, SLC3A1 and ROR2, CA9 and DLL3, CA9 and EPHA2, CA9 and GPC3, CA9 and MSLN, CA9 and ROR1, CA9 and EGFR, CA9 and MUC1, CA9 and B4GALNT1, CA9 and ERBB2, PTPRZ1 and IL13RA2, PTPRZ1 and EPHA2, PTPRZ1 and B4GALNT1, PTPRZ1 and ERBB2, BCAN and IL13RA2, BCAN and GPC3, BCAN and ROR1, BCAN and B4GALNT1, BCAN and ERBB2, MLC1 and IL13RA2, MLC1 and DLL3, MLC1 and MSLN, MLC1 and ROR1, MLC1 and MUC1, MLC1 and B4GALNT1, MLC1 and ERBB2, NLGN3 and IL13RA2, NLGN3 and DLL3, NLGN3 and EPHA2, NLGN3 and GPC3, NLGN3 and MSLN, NLGN3 and ROR1, NLGN3 and EGFR, NLGN3 and MUC1, NRCAM and IL13RA2, NRCAM and DLL3, NRCAM and EPHA2, NRCAM and GPC3, NRCAM and MSLN, NRCAM and ROR1, NRCAM and EGFR, NRCAM and B4GALNT1, NRCAM and ERBB2, CA9 and BCAN, CA9 and MLC1, CA9 and NLGN3, CA9 and NRCAM, PTPRZ1 and BCAN, PTPRZ1 and NLGN3, BCAN and MLC1, BCAN and NLGN3, BCAN and NRCAM, MLC1 and NLGN3, MLC1 and NRCAM, NLGN3 and NRCAM, AQP4 and CA9, AQP4 and BCAN, AQP4 and MLC1, AQP4 and NLGN3, AQP4 and NRCAM, AQP4 and DLL3, AQP4 and EPHA2, AQP4 and GPC3, AQP4 and MSLN, AQP4 and ROR1, AQP4 and MUC1, and AQP4 and ERBB2.

54. A polyspecific-immune inducing polypeptide (PIIP) comprising: a first antigen binding domain specific for a first antigen present on the surface of a target cancer cell and a second antigen binding domain specific for a second antigen present on the surface of the target cancer cell, wherein the first and second antigens are selected from a target antigen pair depicted in FIG. 6, FIG. 7, or FIG. 8.
55. The PIIP of aspects 53 or 54, wherein the PIIP is a polyspecific antibody.
56. The PIIP of aspect 55, wherein the polyspecific antibody is a bispecific antibody.
57. The PIIP of aspects 53 or 54, wherein the PIIP is a polyspecific chimeric antigen receptor (CAR).
58. The PIIP of aspect 57, wherein the polyspecific CAR is a bispecific CAR.
59. The PIIP of aspects 53 or 54, wherein the PIIP is a polyspecific T cell receptor (TCR).
60. The PIIP of aspect 59, wherein the polyspecific TCR is a bispecific TCR.
61. An in vitro or ex vivo genetically modified cytotoxic immune cell, wherein the cytotoxic immune cell is genetically modified to produce a PIIP according to any of aspects 57-59.
62. A method of killing a target cancer cell in an individual, the method comprising administering to the individual an effective amount of a PIIP according to any of aspects 53-60.
63. The method according to aspect 62, wherein the administering comprises administering to the individual an effective amount of cytotoxic immune cells genetically modified to produce the PIIP.

In any of aspects 1-63, the two different cell surface antigens may be FAP and MSLN and the target cancer cell may be a pancreatic cancer cell.

In any of aspects 1-63, the two different cell surface antigens may be FAP and PSCA and the target cancer cell may be a pancreatic cancer cell.

In any of aspects 1-63, the two different cell surface antigens may be PSCA and FAP and the target cancer cell may be a pancreatic cancer cell.

In any of aspects 1-63, the two different cell surface antigens may be MUC1 and FAP and the target cancer cell may be a pancreatic cancer cell.

In any of aspects 1-63, the two different cell surface antigens may be PTPRZ1 and EphA2 and the target cancer cell may be a glioblastoma cell.

In any of aspects 1-63, the two different cell surface antigens may be PTPRZ1 and IL13RA2 and the target cancer cell may be a glioblastoma cell.

In any of aspects 1-63, the two different cell surface antigens may be NRCAM and EphA2 and the target cancer cell may be a glioblastoma cell.

In any of aspects 1-63, the two different cell surface antigens may be NRCAM and IL13RA2 and the target cancer cell may be a glioblastoma cell.

In any of aspects 1-63, the two different cell surface antigens may be CDH10 and EphA2 and the target cancer cell may be a glioblastoma cell.

In any of aspects 1-63, the two different cell surface antigens may be CDH10 and IL13RA2 and the target cancer cell may be a glioblastoma cell.

In any of aspects 1-63, the two different cell surface antigens may be PTPRZ1 and EGFR and the target cancer cell may be a glioblastoma cell.

In any of aspects 1-63, the two different cell surface antigens may be PTPRZ1 and ERBB2 and the target cancer cell may be a glioblastoma cell.

In any of aspects 1-63, the two different cell surface antigens may be PTPRZ1 and DLL3 and the target cancer cell may be a glioblastoma cell.

In any of aspects 1-63, the two different cell surface antigens may be NRCAM and EGFR and the target cancer cell may be a glioblastoma cell.

In any of aspects 1-63, the two different cell surface antigens may be NRCAM and ERBB2 and the target cancer cell may be a glioblastoma cell.

In any of aspects 1-63, the two different cell surface antigens may be NRCAM and DLL3 and the target cancer cell may be a glioblastoma cell.

In any of aspects 1-63, the two different cell surface antigens may be BCAN and EphA2 and the target cancer cell may be a glioblastoma cell.

In any of aspects 1-63, the two different cell surface antigens may be BCAN and IL13RA2 and the target cancer cell may be a glioblastoma cell.

In any of aspects 1-63, the two different cell surface antigens may be BCAN and EGFR and the target cancer cell may be a glioblastoma cell.

In any of aspects 1-63, the two different cell surface antigens may be BCAN and ERBB2 and the target cancer cell may be a glioblastoma cell.

In any of aspects 1-63, the two different cell surface antigens may be BCAN and DLL3 and the target cancer cell may be a glioblastoma cell.

In any of aspects 1-63, the two different cell surface antigens may be CDH10 and EGFR and the target cancer cell may be a glioblastoma cell.

In any of aspects 1-63, the two different cell surface antigens may be CDH10 and ERBB2 and the target cancer cell may be a glioblastoma cell.

In any of aspects 1-63, the two different cell surface antigens may be CDH10 and DLL3 and the target cancer cell may be a glioblastoma cell.

Aspect 64. An in vitro or ex vivo genetically modified cytotoxic immune cell, wherein the cytotoxic immune cell is genetically modified to produce two different polypeptides that recognize two different cell surface antigens, wherein at least one of the two different cell surface antigens is present on the surface of a target cancer cell and the two different cell surface antigens are selected from: AXL and CDH6, CD70 and AXL, MOG and EphA2, MOG and IL13RA2, MOG and EGFR, MOG and ERBB2, MOG and DLL3, MET and CD70, B4GALNT1 and MSLN, CD70 and B4GALNT1, PRR7 and CLDN6, APLN and SEMA5B, KDR and FOLH1, FOLR1 and B4GALNT1, MSLN and LlCAM, PTPRN and FAP, PTRPN and MSLN, CA9 and FAP, CA9 and MSLN, CEACAM5 and FAP, CEACAM5 and MSLN, PSCA and MSLN, MUC1 and MSLN, CA9 and TREM1, GD2 and Kremen2, CDH6 and CD70, CA9 and NOX1, CA9 and KREMEN2, B4GALNT1 and NETO1, FOLH1 and KREMEN2, EGFR and IL13RA2, CA9 and KISS1R, EPHA8 and B4GALNT1, SEMA5B and CA9, SLC2A1 and CA9, PRR7 and CLDN6, SEMA5B and APLN, SYT2 and CALHM3, CHRNG and KCNK9, SYT2 and STRA6, LRP8 and KISS1R, ADAM12 and TMEM132A, and SLC6A17 and ST3GAL4.

Aspect 65. The genetically modified cytotoxic immune cell of aspect 64, wherein the cytotoxic immune cell is a cytotoxic T cell or a natural killer cell.

Aspect 66. The genetically modified cytotoxic immune cell of any of aspects 64-65, wherein the two different polypeptides are antigen-triggered polypeptides selected from the group consisting of: a binding-triggered transcriptional switch (BTTS) and a chimeric antigen receptor (CAR), a BTTS and a T cell receptor (TCR), a CAR and an inhibitory CAR (iCAR), and a first BTTS and a second BTTS.

Aspect 67. The genetically modified cytotoxic immune cell of any of aspects 64-66, wherein the BTTS is a synNotch receptor or a chimeric polypeptide comprising a non-Notch force sensor cleavage domain.

68. A method of killing a target cancer cell in an individual, the method comprising administering to the individual an effective number of the genetically modified cytotoxic immune cell of any one of aspects 64-67, wherein said genetically modified cytotoxic immune cell kills the target cancer cell in the individual.

Aspect 69. A system for killing a target cancer cell, the system comprising: a) a first antigen-triggered polypeptide that binds specifically to a first target antigen, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide, wherein at least one of the first or second target antigens is present on the target cancer cell and the first and second target antigens are selected from: AXL and CDH6, CD70 and AXL, MOG and EphA2, MOG and IL13RA2, MOG and EGFR, MOG and ERBB2, MOG and DLL3, MET and CD70, B4GALNT1 and MSLN, CD70 and B4GALNT1, PRR7 and CLDN6, APLN and SEMA5B, KDR and FOLH1, FOLR1 and B4GALNT1, MSLN and L1CAM, PTPRN and FAP, PTRPN and MSLN, CA9 and FAP, CA9 and MSLN, CEACAM5 and FAP, CEACAM5 and MSLN, PSCA and MSLN, MUC1 and MSLN, CA9 and TREM1, GD2 and Kremen2, CDH6 and CD70, CA9 and NOX1, CA9 and KREMEN2, B4GALNT1 and NETO1, FOLH1 and KREMEN2, EGFR and IL13RA2, CA9 and KISS1R, EPHA8 and B4GALNT1, SEMA5B and CA9, SLC2A1 and CA9, PRR7 and CLDN6, SEMA5B and APLN, SYT2 and CALHM3, CHRNG and KCNK9, SYT2 and STRA6, LRP8 and KISS1R, ADAM12 and TMEM132A, and SLC6A17 and ST3GAL4.

Aspect 70. The system of aspect 66, wherein the first antigen-triggered polypeptide is a binding-triggered transcriptional switch (BTTS), and the second antigen-triggered polypeptide is a chimeric antigen receptor (CAR).

Aspect 71. The system of aspect 66, wherein the first antigen-triggered polypeptide is a binding-triggered transcriptional switch (BTTS), and the second antigen-triggered polypeptide is an inhibitory CAR (iCAR).

Aspect 72. The system of aspect 66, wherein: a) the first antigen-triggered polypeptide is a binding-triggered transcriptional switch (BTTS), and the second antigen-triggered polypeptide is one polypeptide chain of a split CAR; b) the first antigen-triggered polypeptide is a BTTS, and the second antigen-triggered polypeptide is a T-cell receptor; c) the first antigen-triggered polypeptide is a BTTS, and the second antigen-triggered polypeptide is an immunoinhibitory polypeptide; or d) the first antigen-triggered polypeptide is a first BTTS, and the second antigen-triggered polypeptide is a second BTTS.

Aspect 73. The system of any of aspects 70-73, wherein the BTTS is a synNotch receptor or a chimeric polypeptide comprising a non-Notch force sensor cleavage domain.

Aspect 74. The system of aspect 66, wherein the first target antigen and the second target antigen are both present on the surface of a target cancer cell.

Aspect 75. The system of aspect 66, wherein: a) the first target antigen and the second target antigen are both present on the surface of a non-cancerous cell; and b) wherein the first target antigen, but not the second target antigen, is present on the surface of a target cancer cell.

Aspect 76. A method of killing a target cancer cell in an individual, the method comprising: a) introducing the system of any one of aspects 69-75 into a cytotoxic T cell in vitro or ex vivo, generating a modified cytotoxic T cell; and b) administering the modified cytotoxic T cell to the individual.

Aspect 77. A polyspecific-immune-inducing polypeptide (PIIP) comprising: a first antigen binding domain specific for a first antigen present on the surface of a target cancer cell and a second antigen binding domain specific for a second antigen present on the surface of the target cancer cell, wherein the first and second antigens are selected from: AXL and CDH6, CD70 and AXL, MOG and EphA2, MOG and IL13RA2, MOG and EGFR, MOG and ERBB2, MOG and DLL3, MET and CD70, B4GALNT1 and MSLN, CD70 and B4GALNT1, PRR7 and CLDN6, APLN and SEMA5B, KDR and FOLH1, FOLR1 and B4GALNT1, MSLN and LlCAM, PTPRN and FAP, PTRPN and MSLN, CA9 and FAP, CA9 and MSLN, CEACAM5 and FAP, CEACAM5 and MSLN, PSCA and MSLN, MUC1 and MSLN, CA9 and TREM1, GD2 and Kremen2, CDH6 and CD70, CA9 and NOX1, CA9 and KREMEN2, B4GALNT1 and NETO1, FOLH1 and KREMEN2, EGFR and IL13RA2, CA9 and KISS1R, EPHA8 and B4GALNT1, SEMA5B and CA9, SLC2A1 and CA9, PRR7 and CLDN6, SEMA5B and APLN, SYT2 and CALHM3, CHRNG and KCNK9, SYT2 and STRA6, LRP8 and KISS1R, ADAM12 and TMEM132A, and SLC6A17 and ST3GAL4

Aspect 78. The PIIP of aspect 77, wherein the PIIP is a polyspecific antibody.

Aspect 79. The PIIP of aspect 77, wherein the polyspecific antibody is a bispecific antibody.

Aspect 80. The PIIP of aspects 77-79, wherein the PIIP is a polyspecific chimeric antigen receptor (CAR).

Aspect 81. The PIIP of aspect 80, wherein the polyspecific CAR is a bispecific CAR.

Aspect 82. The PIIP of aspect 77-79, wherein the PIIP is a polyspecific T cell receptor (TCR).

Aspect 83. The PIIP of aspect 82, wherein the polyspecific TCR is a bispecific TCR.

Aspect 84. An in vitro or ex vivo genetically modified cytotoxic immune cell, wherein the cytotoxic immune cell is genetically modified to produce a PIIP according to any of aspects 57-59.

Aspect 85. A method of killing a target cancer cell in an individual, the method comprising administering to the individual an effective amount of a PIIP according to any of aspects 53-60.

Aspect 86. The method according to aspect 85, wherein the administering comprises administering to the individual an effective amount of cytotoxic immune cells genetically modified to produce the PIIP.

In any of aspects 64-86, the two different cell surface antigens may be AXL and CDH6 and the target cancer cell may be a renal cell carcinoma cell.

In any of aspects 64-86, the two different cell surface antigens may be CD70 and AXL and the target cancer cell may be a renal clear cell carcinoma cell.

In any of aspects 64-86, the two different cell surface antigens may be MOG and EphA2 and the target cancer cell may be a glioblastoma cell.

In any of aspects 64-86, the two different cell surface antigens may be MOG and IL13RA2 and the target cancer cell may be a glioblastoma cell.

In any of aspects 64-86, the two different cell surface antigens may be MOG and EGFR and the target cancer cell may be a glioblastoma cell.

In any of aspects 64-86, the two different cell surface antigens may be MOG and ERBB2 and the target cancer cell may be a glioblastoma cell.

In any of aspects 64-86, the two different cell surface antigens may be MOG and DLL3 and the target cancer cell may be a glioblastoma cell.

In any of aspects 64-86, the two different cell surface antigens may be MET and CD70 and the target cancer cell may be a renal clear cell carcinoma cell.

In any of aspects 64-86, the two different cell surface antigens may be B4GALNT1 and MSLN and the target cancer cell may be a mesothelioma cell.

In any of aspects 64-86, the two different cell surface antigens may be CD70 and B4GALNT1 and the target cancer cell may be a head and neck squamous carcinoma cell.

In any of aspects 64-86, the two different cell surface antigens may be PRR7 and CLDN6 and the target cancer cell may be a ovarian cell.

In any of aspects 64-86, the two different cell surface antigens may be APLN and SEMA5B and the target cancer cell may be a renal clear cell carcinoma cell.

In any of aspects 64-86, the two different cell surface antigens may be KDR and FOLH1 and the target cancer cell may be a renal clear cell carcinoma cell.

In any of aspects 64-86, the two different cell surface antigens may be FOLR1 and B4GALNT1 and the target cancer cell may be a ovarian serous cystadenocarcinoma cell.

In any of aspects 64-86, the two different cell surface antigens may be MSLN and L1CAM and the target cancer cell may be a ovarian serous cystadenocarcinoma cell.

In any of aspects 64-86, the two different cell surface antigens may be PTPRN and FAP and the target cancer cell may be a pancreatic cancer cell.

In any of aspects 64-86, the two different cell surface antigens may be PTRPN and MSLN and the target cancer cell may be a pancreatic cancer cell.

In any of aspects 64-86, the two different cell surface antigens may be CA9 and FAP and the target cancer cell may be a pancreatic cancer cell.

In any of aspects 64-86, the two different cell surface antigens may be CA9 and MSLN and the target cancer cell may be a pancreatic cancer cell.

In any of aspects 64-86, the two different cell surface antigens may be CEACAM5 and FAP and the target cancer cell may be a pancreatic cancer cell.

In any of aspects 64-86, the two different cell surface antigens may be CEACAM5 and MSLN and the target cancer cell may be a pancreatic cancer cell.

In any of aspects 64-86, the two different cell surface antigens may be PSCA and MSLN and the target cancer cell may be a pancreatic cancer cell.

In any of aspects 64-86, the two different cell surface antigens may be MUC1 and MSLN and the target cancer cell may be a pancreatic cancer cell.

In any of aspects 64-86, the two different cell surface antigens may be CA9 and TREM1 and the target cancer cell may be a lung adenocarcinoma cell.

In any of aspects 64-86, the two different cell surface antigens may be GD2 and Kremen2 and the target cancer cell may be a HNSCC cell.

In any of aspects 64-86, the two different cell surface antigens may be CDH6 and CD70 and the target cancer cell may be a renal clear cell carcinoma cell.

In any of aspects 64-86, the two different cell surface antigens may be CA9 and NOX1 and the target cancer cell may be a colon adenocarcinoma cell.

In any of aspects 64-86, the two different cell surface antigens may be CA9 and KREMEN2 and the target cancer cell may be a cervical squamous cell carcinoma or endocervical adenocarcinoma cell.

In any of aspects 64-86, the two different cell surface antigens may be B4GALNT1 and NETO1 and the target cancer cell may be a brain lower grade glioma cell.

In any of aspects 64-86, the two different cell surface antigens may be FOLH1 and KREMEN2 and the target cancer cell may be a prostate adenocarcinoma cell.

In any of aspects 64-86, the two different cell surface antigens may be EGFR and IL13RA2 and the target cancer cell may be a pheochromocytoma or paraganglioma cell.

In any of aspects 64-86, the two different cell surface antigens may be CA9 and KISS1R and the target cancer cell may be a mesothelioma cell.

In any of aspects 64-86, the two different cell surface antigens may be EPHA8 and B4GALNT1 and the target cancer cell may be a pheochromocytoma or paraganglioma cell.

In any of aspects 64-86, the two different cell surface antigens may be SEMA5B and CA9 and the target cancer cell may be a kidney renal clear cell carcinoma cell.

In any of aspects 64-86, the two different cell surface antigens may be SLC2A1 and CA9 and the target cancer cell may be a head and neck squamous cell carcinoma cell.

In any of aspects 64-86, the two different cell surface antigens may be PRR7 and CLDN6 and the target cancer cell may be a ovarian serous cystadenocarcinoma cell.

In any of aspects 64-86, the two different cell surface antigens may be SEMA5B and APLN and the target cancer cell may be a renal cell carcinoma cell.

In any of aspects 64-86, the two different cell surface antigens may be SYT2 and CALHM3 and the target cancer cell may be a testicular germ cell tumor cell.

In any of aspects 64-86, the two different cell surface antigens may be CHRNG and KCNK9 and the target cancer cell may be a stomach adenocarcinoma cell.

In any of aspects 64-86, the two different cell surface antigens may be SYT2 and STRA6 and the target cancer cell may be a testicular germ cell tumor cell.

In any of aspects 64-86, the two different cell surface antigens may be LRP8 and KISS1R and the target cancer cell may be a lung squamous cell carcinoma cell.

In any of aspects 64-86, the two different cell surface antigens may be ADAM12 and TMEM132A and the target cancer cell may be a breast invasive carcinoma cell.

In any of aspects 64-86, the two different cell surface antigens may be SLC6A17 and ST3GAL4 and the target cancer cell may be a uveal melanoma cell.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1: Use of an AND Gate Antigen Pair as Target Antigens $CD8^+$ T cells are isolated from a patient with a breast cancer. The $CD8^+$ T cells are genetically modified with: a) a recombinant expression vector comprising a nucleotide sequence encoding a synNotch polypeptide or other binding-triggered transcriptional switch (BTTS) that includes: i) an scFv that is specific for a FAP polypeptide; and ii) an intracellular domain comprising a transcription activator; and b) a recombinant expression vector comprising a nucleotide sequence encoding a CAR that comprises an antigen-binding portion (e.g., a scFv) specific for a CLDN3 polypeptide. From $10^6$ to $10^9$ genetically modified $CD8^+$ T cells are administered to the patient in a single dose intravenously. Upon binding of the genetically modified $CD8^+$ T cells to a FAP present on the surface of a breast cancer cell in the patient, the transcription activator is released from the synNotch polypeptide of other BTTS. The CAR is encoded by a nucleotide sequence that is operably linked to a promoter element that is controlled by the released transcription activator. The released transcription activator induces expression of the CAR in the genetically modified $CD8^+$ T cells. The CAR binds to a CLDN3 polypeptide present on the surface of the breast cancer cell in the patient.

Example 2: Combinatorial Antigen Recognition to Improve Cancer Vs Normal Tissue Recognition Most cancer therapies, including engineered T cell therapies, target a single molecule for recognition. But specificity of recognition remains a major problem: many tumor-associated antigens, especially those in solid tumors, are shared with normal epithelial tissues, leading to toxic cross-reaction. New synthetic biology approaches, however, have led to the engineering of therapeutic T cells that recognize tumors based on Boolean combinatorial antigen signatures (e.g. AND or AND-NOT gates). Here we perform a comprehensive bioinformatic study to evaluate how effective combinatorial antigen recognition could be in improving selective recognition of cancers. We searched tumor and normal tissue expression data for all possible cell surface protein combinations in the human genome (>$5\times10^6$ possible combinations). We find that for most cancers types there are numerous antigen combinations that are predicted to significantly improve the precision and recall of tumor vs normal tissue recognition. We identify secondary antigens predicted to significantly improve selectivity of current clinical antigen targets, as well as novel antigen pairs and triplets that show near ideal predicted discrimination. This analysis indicates that there is rich discriminatory information within combinations of 2-3 surface antigens that can be tapped by synthetic circuits to yield precision cancer cell therapies.

Figure 9:
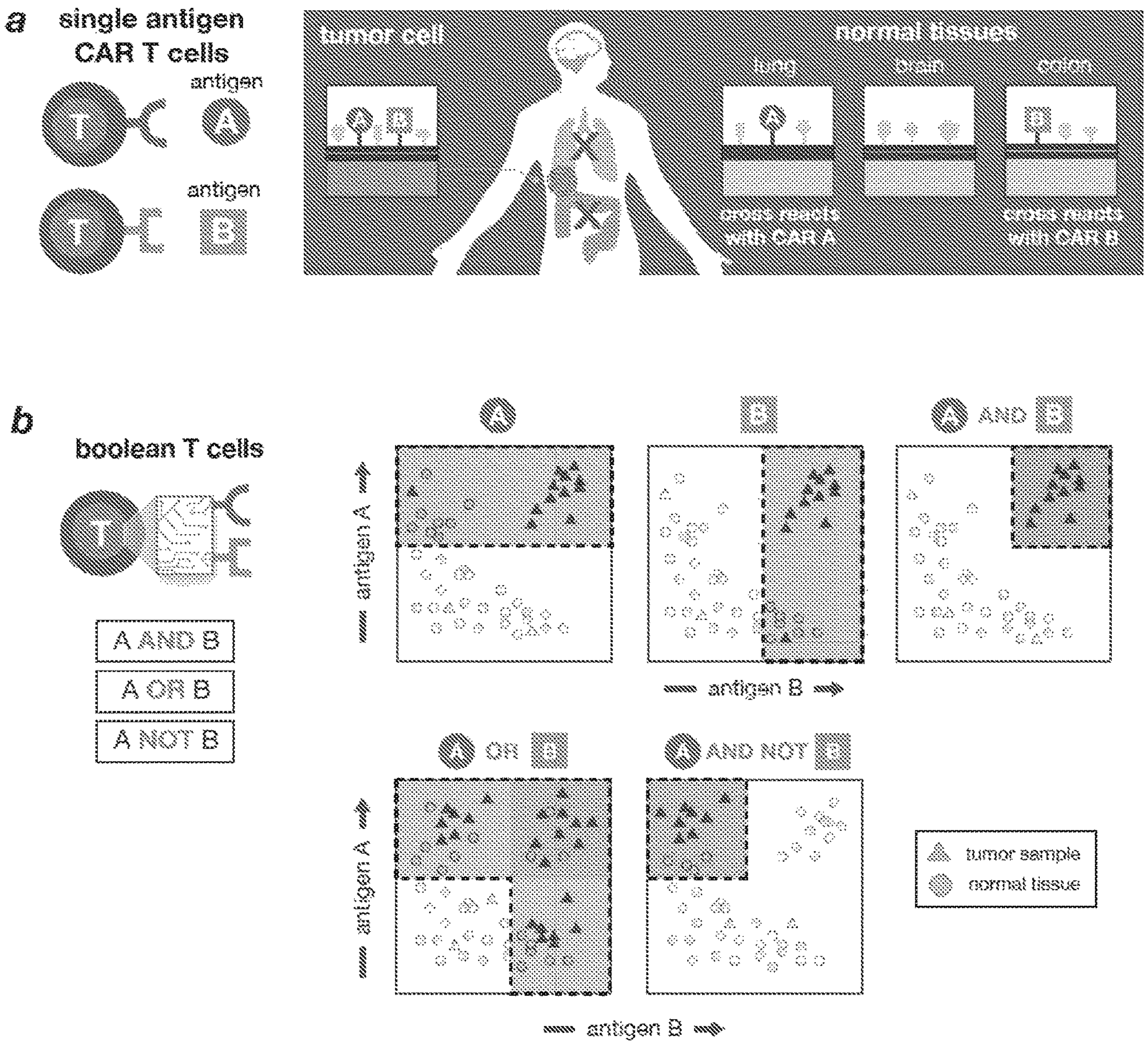
FIG. 9 panels a and b depict the problem of antigen cross-reactivity in T cell therapies for cancer and increased discriminatory recognition using Boolean recognition circuits.

FIG. 9A depicts the problem of antigen cross-reactivity in T cell therapies for cancer. Tumor cell may express antigens A and B, but CAR T cells targeted against each individual antigen can cross-react with normal tissues that express A or B individually. FIG. 9B demonstrates that T cells engineered with Boolean recognition circuits can show increased discriminatory recognition. In the top row, the combinatorial requirement for antigens A and B can remove cross-reactivity with normal tissues that express either A or B individually. In other cases (bottom row) OR gates can be used to capture more cases of a tumor, and AND-NOT gates (e.g. A high and B low) could also improve recognition via negative selection.

Figure 10:
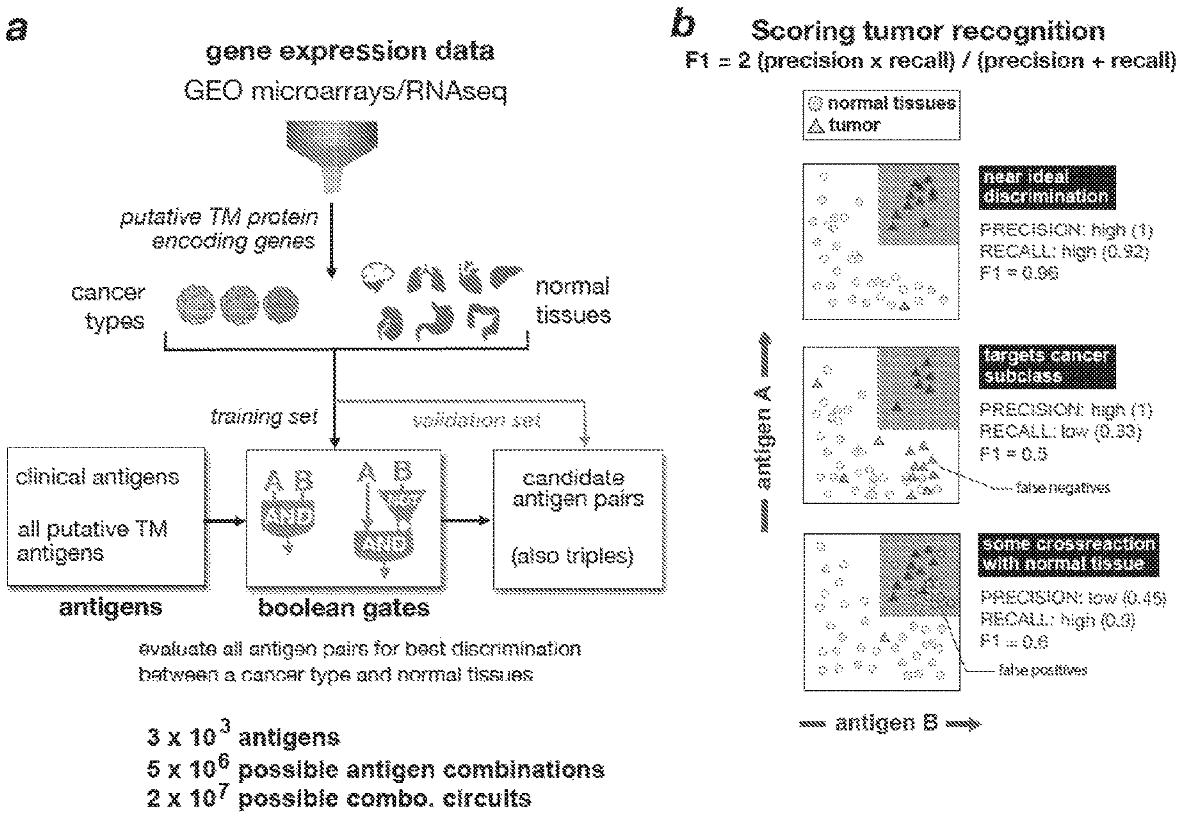
FIG. 10 panels a and b demonstrate a pipeline for identifying combinatorial antigen pairs with improved cancer discrimination.

Example 3: Pipeline for Identifying Combinatorial Antigen Pairs with Improved Cancer Discrimination FIG. 10A shows how gene expression data from the gene expression omnibus (GEO) for normal and cancer tissues were filtered for predicted transmembrane proteins and current clinical CAR targets (FIG. 16). The resulting 5×106 possible antigen combinations were then screened for ability to discrimination a particular cancer type from all normal tissues. FIG. 10B depicts scoring of recognition. The F1 score incorporates both precision (lack of false positives) and recall (lack of false negatives).

Figure 11:
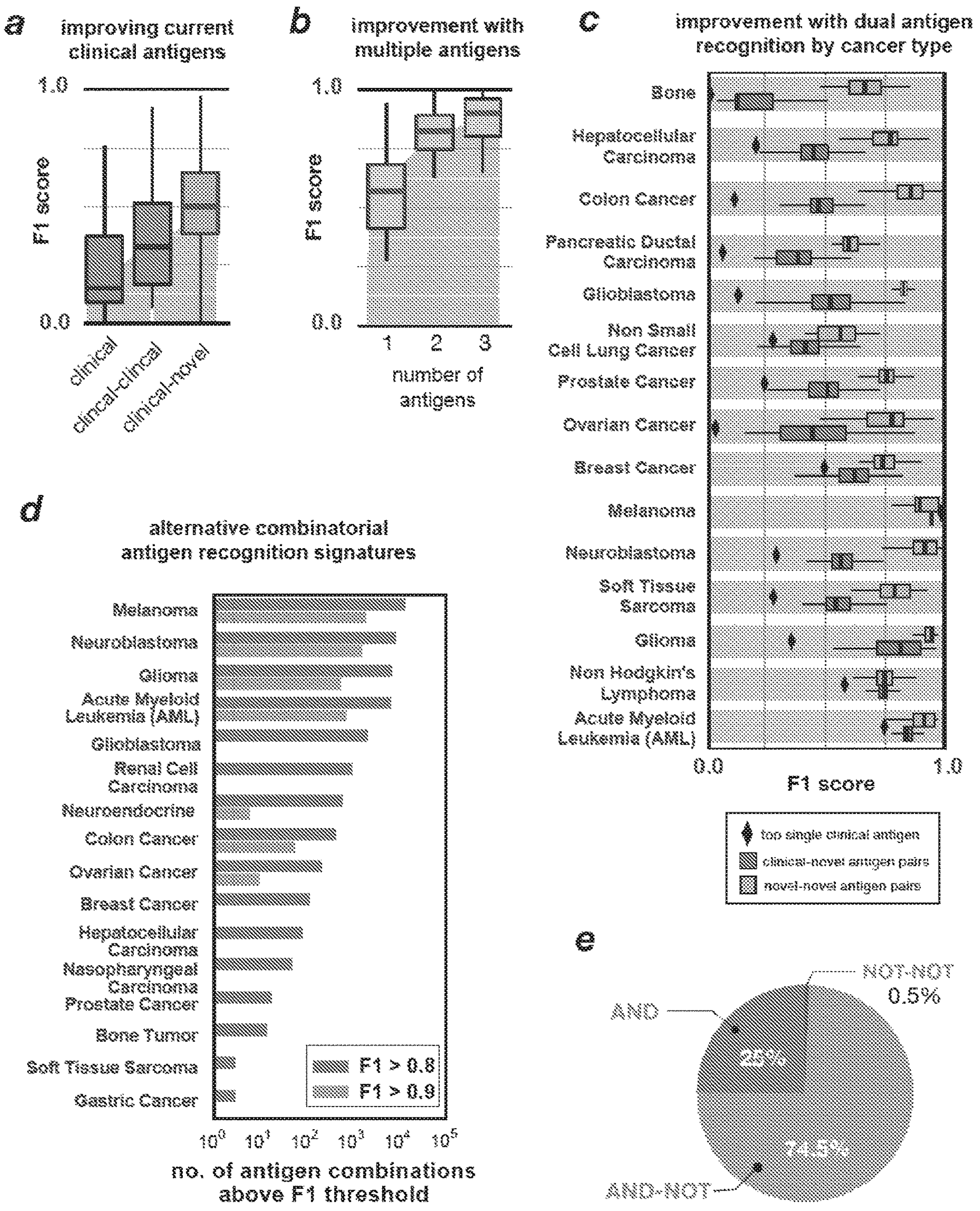
FIG. 11 panels a-e provide examples showing combinatorial antigens can significantly improve discrimination between cancer and normal tissues.

Example 4: Combinatorial Antigens can Significantly Improve Discrimination Between Cancer and Normal Tissues FIG. 11A-11E demonstrates the improvement achieved in discriminating cancer and non-cancer (i.e., normal) tissues through the use of combinatorial antigens, including improvement in current clinical antigens (FIG. 11A), improvement with multiple antigens (FIG. 11B), and improvement in particular cancer types using dual antigen recognition (FIG. 11C). FIG. 11D depicts that various different antigen combinations are available for various cancers and FIG. 11E depicts the relative amounts of different types of antigen logic combinations generated. The data shows that: clinical antigens can be improved by including the clinical antigen in an antigen combination; that 2-3 antigen combinations are sufficient to yield near ideal recognition (i.e., F1 of about 1.0); antigen combinations provide improvements in all evaluated cancer types; there are many alternative solutions produced; and that AND-NOT combinations were more frequently produced than AND combinations.

Example 5: Examples of Antigen Pairs with Improved Combinatorial Performance

Figure 12:
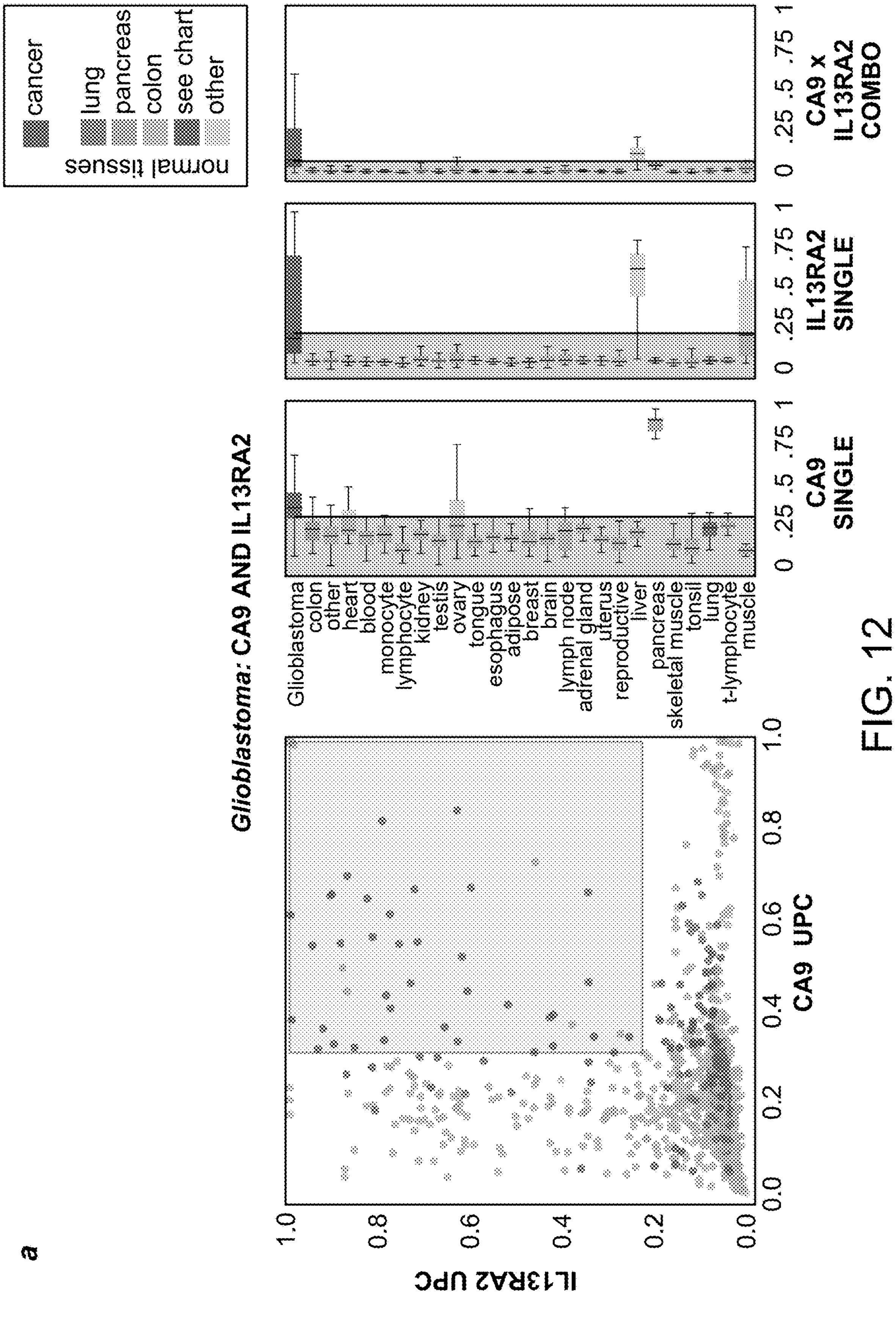
FIG. 12 panels a-c provide examples of clinical:novel antigen pairs with improved combinatorial performance.
Figure 13:
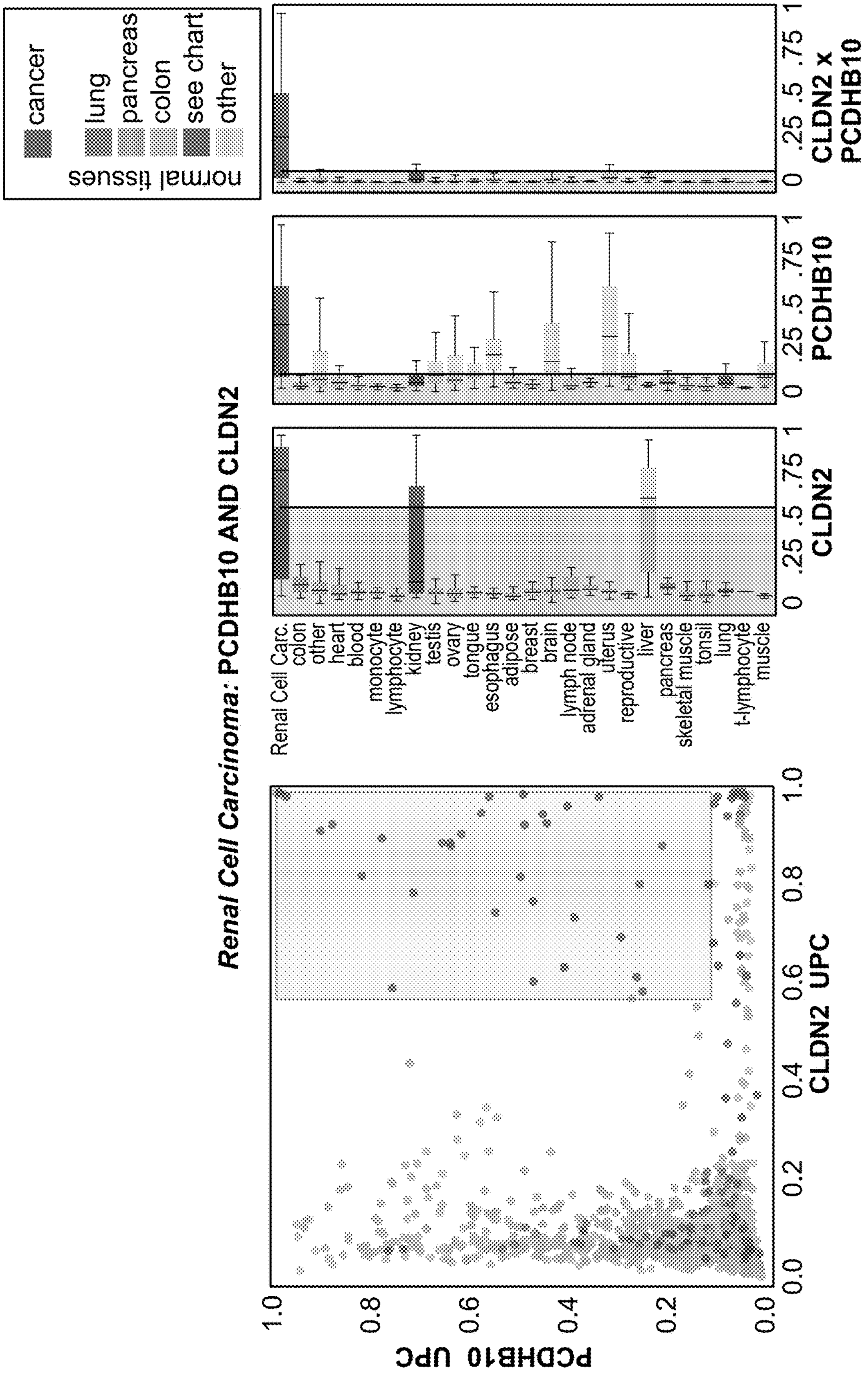
FIG. 13 provides examples of novel:novel TM antigen pairs with improved combinatorial performance.
Figure 14:
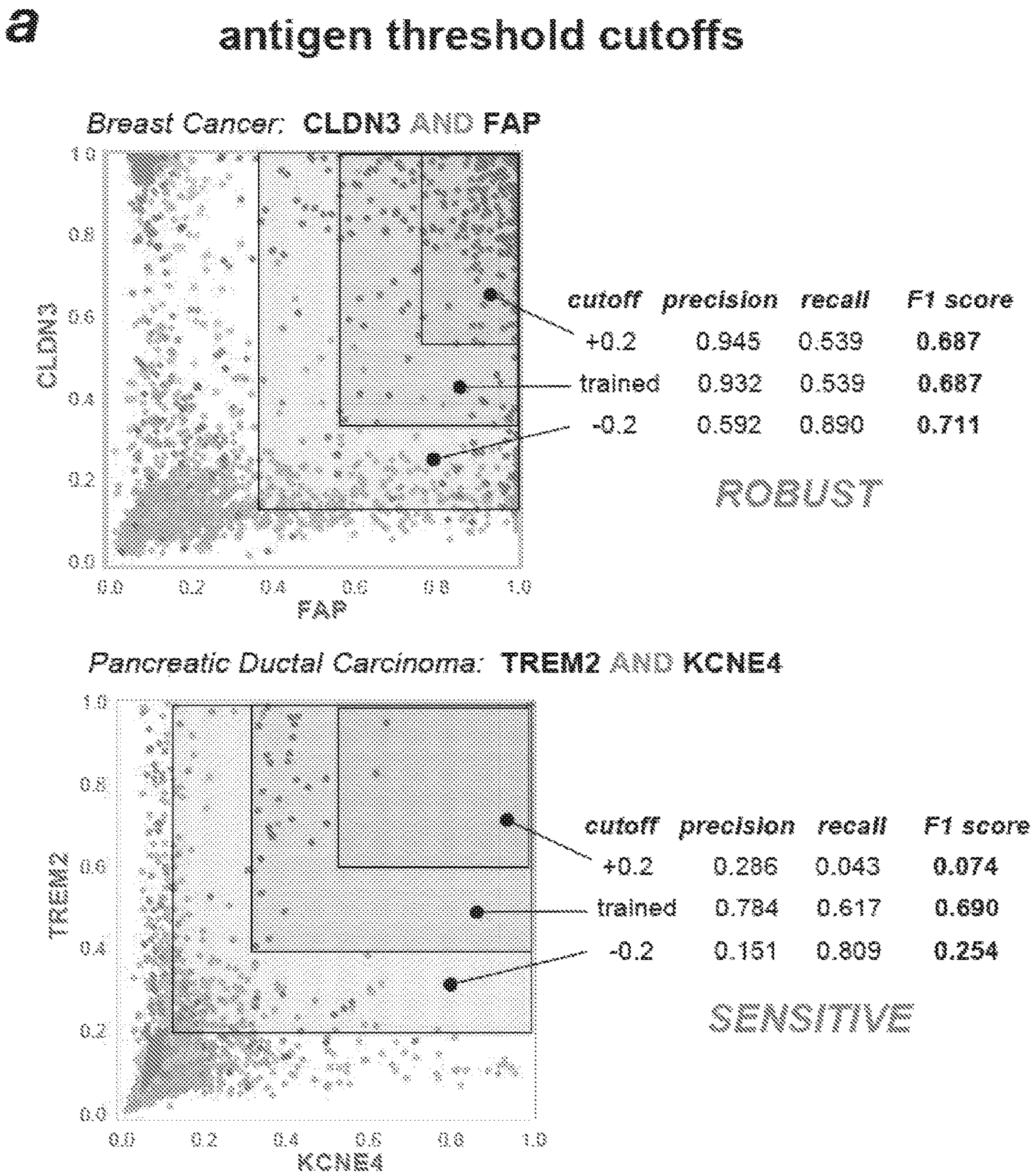
FIG. 14 panels a-b demonstrates how further improvements in combinatorial recognition of cancer can be made.
Figure 14:
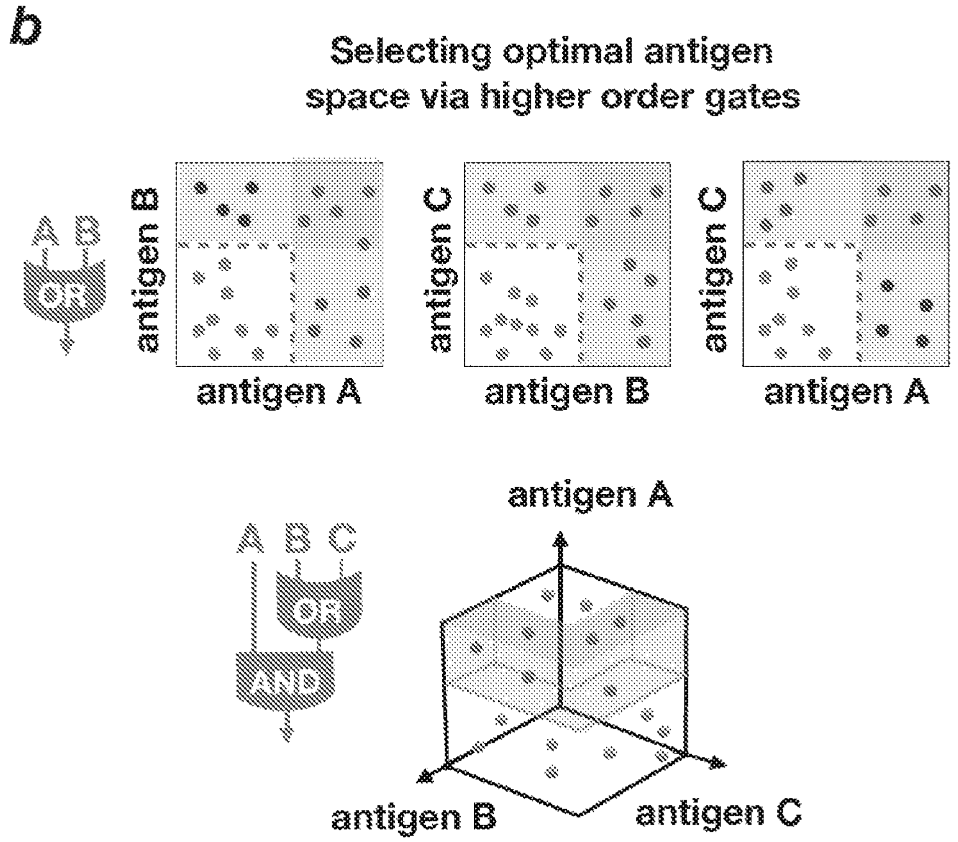

FIG. 12 provides examples of clinical:novel antigen pairs with improved combinatorial performance. FIG. 13 provides examples of novel:novel TM antigen pairs with improved combinatorial performance. FIG. 14 demonstrates how further improvements in combinatorial recognition of cancer can be made, e.g., through tuning of antigen expression cutoff or combining different types of logic gates to optimize discrimination of cancer vs normal tissues.

Example 6: Identifying Combinatorial Circuits

Figure 15:
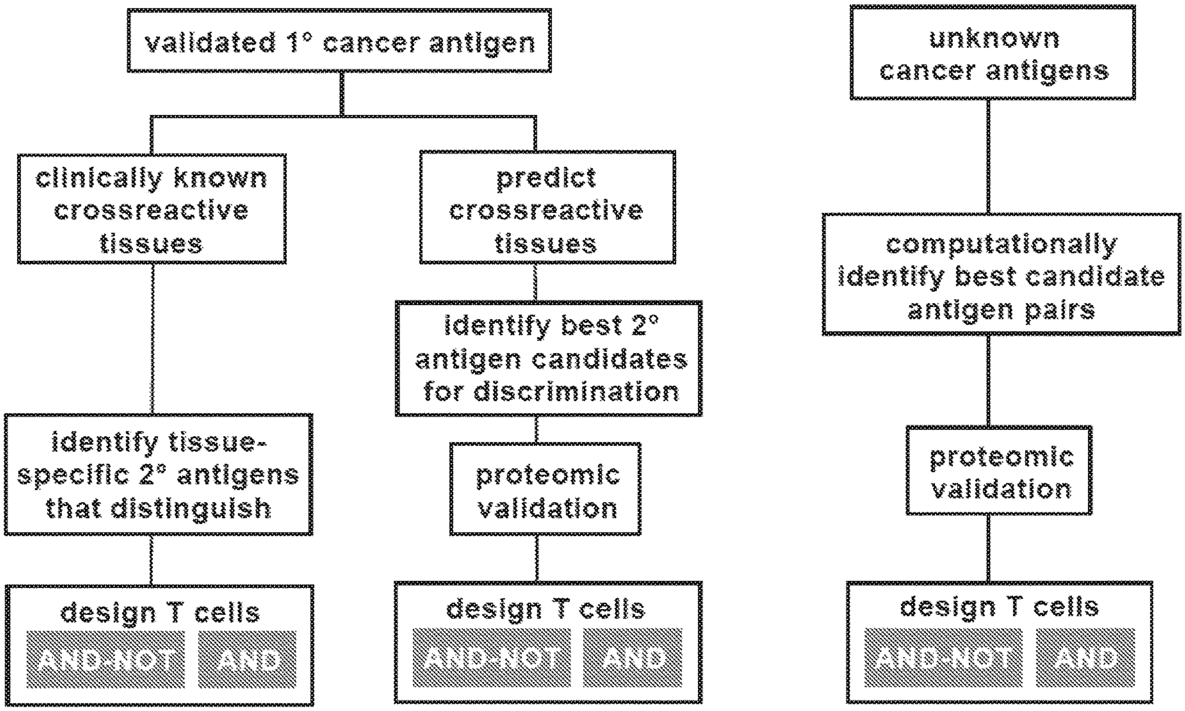
FIG. 15 provides flow charts demonstrating how combinatorial circuits for cancer recognition were identified in some embodiments FIG. 16 provides a table of current clinically targeted CAR and TCR targets for solid tumors.

FIG. 15 provides flow charts demonstrating how combinatorial circuits for cancer recognition were identified in some embodiments by harnessing bioinformatic data and combining such data with boolean circuit design capabilities. The provided flow charts demonstrate strategies employed starting from a primary validated cancer antigen as well as starting from an unknown cancer antigen. Such combinations may be further optimized in some instances by e.g., tuning antigen thresholds.

Example 7: Specific Pairs for the Treatment of Pancreatic Cancer and Glioblastoma The following antigen pairs are particularly useful for the treatment of pancreatic cancer: FAP and MSLN, FAP and PSCA, PSCA and FAP, and MUC1 and FAP. These pairs that have been experimentally validated.

The following antigen pairs are particularly useful for the treatment of glioma, particularly glioblastoma: PTPRZ1 and EphA2, PTPRZ1 and IL13RA2, NRCAM and EphA2, NRCAM and IL13RA2, CDH10 and EphA2, CDH10 and IL13RA2, PTPRZ1 and EGFR, PTPRZ1 and ERBB2, PTPRZ1 and DLL3, NRCAM and EGFR, NRCAM and ERBB2, NRCAM and DLL3, BCAN and EphA2, BCAN and IL13RA2, BCAN and EGFR, BCAN and ERBB2, BCAN and DLL3, CDH10 and EGFR, CDH10 and ERBB2, and CDH10 and DLL3. Many of these pairs that have been experimentally validated.

Example 8: Specific Pairs for the Treatment of Pancreatic and Other Cancers

The following antigen pairs are particularly useful for the treatment of pancreatic cancer: PTPRN and FAP, PTRPN and MSLN, CA9 and FAP, CA9 and MSLN, CEACAM5 and FAP, CEACAM5 and MSLN, PSCA and MSLN, and MUC1 and MSLN.

The following antigen pairs are particularly useful for the treatment of other cancers: AXL and CDH6 (renal cell carcinoma), CD70 and AXL (renal clear cell carcinoma), MOG and EphA2 (glioblastoma, glioma), MOG and IL13RA2 (glioblastoma, glioma), MOG and EGFR (glioblastoma, glioma), MOG and ERBB2 (glioblastoma, glioma), MOG and DLL3 (glioblastoma, glioma), MET and CD70 (renal clear cell carcinoma), B4GALNT1 and MSLN (mesothelioma), CD70 and B4GALNT1 (Head and Neck squamous carcinoma), PRR7 and CLDN6 (ovarian), APLN and SEMA5B (renal clear cell carcinoma), KDR:FOLH1 (Renal clear cell carcinoma), FOLR1:B4GALNT1 (Ovarian serous Cystadenocarcinoma), MSLN and LlCAM (Ovarian serous Cystadenocarcinoma), CA9 and TREM1 (Lung Adenocarcinoma), GD2 and Kremen2 (HNSCC), CDH6 and CD70 (renal cell carcinoma), CA9 and NOX1 (Colon Adenocarcinoma), CA9 and KREMEN2 (Cervical Squamous Cell Carcinoma and Endocervical Adenocarcinoma), B4GALNT1:NETO1 (Brain Lower Grade Glioma), FOLH1:KREMEN2 (Prostate Adenocarcinoma), EGFR and IL13RA2 (Pheochromocytoma and Paraganglioma), CA9: KISS1R (Mesothelioma), EPHA8:B4GALNT1 (Pheochromcytoma and Paraganglioma), SEMA5B:CA9 (Kidney Renal Clear Cell Carcinoma), SLC2A1:CA9 (Head and Neck Squamous Cell Carcinoma), PRR7 CLDN6 (Ovarian Serous Cystadenocarcinoma), SEMA5B:APLN (RCC), SYT2 and CALHM3 (Testicular Germ Cell Tumor), CHRNG:KCNK9 (Stomach Adenocarcinoma), SYT2 and STRA6 (Testicular Germ Cell Tumors), LRP8:KISS1R (Lung Squamous Cell Carcinoma), ADAM12:TMEM132A (Breast Invasive Carcinoma) and SLC6A17:ST3GAL4 (Uveal Melanoma). Some of these pairs that have been experimentally validated.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (543 sequences)

SEQ ID NO: 1 - protein, 99 aa, Homo sapiens
MAAPAEPCAGQGVWNQTEPEPAATSLLSLCFLRTAGVWVPPMYLWVLGPIYLLFIHHHGRGYLRMSPLFKAKMVAAIPGSLEPGNVRGRQGTGWNLVKS

SEQ ID NO: 2 - protein, 1503 aa, Homo sapiens
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALVCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 3 - protein, 722 aa, Homo sapiens
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 4 - protein, 687 aa, Homo sapiens
MLTFFLVSGGSLWLFVEFVLSLLEKMQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 5 - protein, 697 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 6 - protein, 708 aa, Homo sapiens
MPEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 7 - protein, 622 aa, Homo sapiens
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 8 - protein, 722 aa, Homo sapiens
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 9 - protein, 737 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAGKEARQEAAESNRERGQGQEPVGSQEHASTASLTLI

SEQ ID NO: 10 - protein, 735 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 11 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 12 - protein, 738 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 13 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 14 - protein, 820 aa, Homo sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 15 - protein, 820 aa, Homo sapiens; identical to SEQ ID NO: 14

SEQ ID NO: 16 - protein, 820 aa, Homo sapiens; identical to SEQ ID NO: 14

SEQ ID NO: 17 - protein, 820 aa, Homo sapiens; identical to SEQ ID NO: 14

SEQ ID NO: 18 - protein, 820 aa, Homo sapiens; identical to SEQ ID NO: 14

SEQ ID NO: 19 - protein, 820 aa, Homo sapiens; identical to SEQ ID NO: 14

SEQ ID NO: 20 - protein, 820 aa, Homo sapiens; identical to SEQ ID NO: 14

SEQ ID NO: 21 - protein, 1077 aa, Homo sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKEHECMRIKILGDCYYCVSGLPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 22 - protein, 1077 aa, Homo sapiens; identical to SEQ ID NO: 21

SEQ ID NO: 23 - protein, 1077 aa, Homo sapiens; identical to SEQ ID NO: 21

SEQ ID NO: 24 - protein, 386 aa, Homo sapiens
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 25 - protein, 413 aa, Homo sapiens
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 26 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 27 - protein, 570 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 28 - protein, 133 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFSK

SEQ ID NO: 29 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 30 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 31 - protein, 522 aa, Homo sapiens
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 32 - protein, 522 aa, Homo sapiens; identical to SEQ ID NO: 31

SEQ ID NO: 33 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 34 - protein, 301 aa, Homo sapiens
MVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 35 - protein, 1196 aa, Homo sapiens
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 36 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 37 - protein, 1047 aa, Homo sapiens
MTDNIPLQPVRQKKRMDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 38 - protein, 885 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 39 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 40 - protein, 478 aa, Homo sapiens
MWLGRRALCALVLLLACASLGLLYASTRDAPGLRLPLAPWAPPQSPRRPELPDLAPEPRYAHIPVRIKEQVVGSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 41 - protein, 328 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGARPGWRDGQAGQTEKNQKGWSGQMAEGMGGIWAMARAVQPHNGCFNWTSRARGRKGAFVHLGLEQARGKPEPWVCLPFRPTVGGPRKRLV

SEQ ID NO: 42 - protein, 533 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 43 - protein, 260 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 44 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 45 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 46 - protein, 246 aa, Homo sapiens
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 47 - protein, 313 aa, Homo sapiens
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 48 - protein, 246 aa, Homo sapiens; identical to SEQ ID NO: 46

SEQ ID NO: 49 - protein, 246 aa, Homo sapiens; identical to SEQ ID NO: 46

SEQ ID NO: 50 - protein, 562 aa, Homo sapiens
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 51 - protein, 398 aa, Homo sapiens
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGKQMPKNEWKMEDIKIPLPQPQFQCAKSDPGG

SEQ ID NO: 52 - protein, 72 aa, Homo sapiens
MFLISSSVHGSDEHGRLLRRTLMRYVNLTSLLIFRSVSTAVYKRFPTMDHVVEAERTGMKPILPSSFEMQSF

SEQ ID NO: 53 - protein, 72 aa, Homo sapiens; identical to SEQ ID NO: 52

SEQ ID NO: 54 - protein, 668 aa, Homo sapiens
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 55 - protein, 455 aa, Homo sapiens
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 56 - protein, 450 aa, Homo sapiens
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQNNDIVQSLAAFQKYGNDQIPLAPNTGRANQQMGGGFFSGVLTALTGVAVVLLVYHWSSRESEHDLLVHKAVAKWTAEEVVLWLEQLGPWASLYRERFLSERVNGRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 57 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 58 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 59 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 60 - protein, 114 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDAYESYKKKDYTQVDYLINGMYADSEM

SEQ ID NO: 61 - protein, 449 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 62 - protein, 113 aa, Homo sapiens
MNETNKTLVGPSELPTASAVAPGPGTGARAWPVLVGFVLGAVVLSLLIALAAKCHLCRRYHASYRHRPLPETGRGGRPQVAEDEDDDGFIEDNYIQPGTGELGTEGSRDHFSL

SEQ ID NO: 63 - protein, 113 aa, Homo sapiens; identical to SEQ ID NO: 62

SEQ ID NO: 64 - protein, 281 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 65 - protein, 281 aa, Homo sapiens; identical to SEQ ID NO: 64

SEQ ID NO: 66 - protein, 281 aa, Homo sapiens; identical to SEQ ID NO: 64

SEQ ID NO: 67 - protein, 199 aa, Homo sapiens
MYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 68 - protein, 459 aa, Homo sapiens
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 69 - protein, 414 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 70 - protein, 471 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 71 - protein, 453 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHDSRAGEEGSIRAVDHAVIGGVVAVVVFAMLCLLIILGRYFARHKGTYFTHEAKGADDAADADTAIINAEGGQNNSEEKKEYFI

SEQ ID NO: 72 - protein, 443 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 73 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 74 - protein, 398 aa, Homo sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 75 - protein, 352 aa, Homo sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNDTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 76 - protein, 432 aa, Homo sapiens
MGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 77 - protein, 352 aa, Homo sapiens [sequence omitted]

SEQ ID NO: 78 - protein, 352 aa, Homo sapiens [sequence omitted]

SEQ ID NO: 79 - protein, 1021 aa, Homo sapiens
MAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 80 - protein, 1021 aa, Homo sapiens; identical to SEQ ID NO: 79

SEQ ID NO: 81 - protein, 1021 aa, Homo sapiens; identical to SEQ ID NO: 79

SEQ ID NO: 82 - protein, 176 aa, Homo sapiens
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 83 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 84 - protein, 237 aa, Homo sapiens
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 85 - protein, 310 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVR

SEQ ID NO: 86 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 87 - protein, 472 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 88 - protein, 472 aa, Homo sapiens; identical to SEQ ID NO: 87

SEQ ID NO: 89 - protein, 472 aa, Homo sapiens; identical to SEQ ID NO: 87

SEQ ID NO: 90 - protein, 472 aa, Homo sapiens; identical to SEQ ID NO: 87

SEQ ID NO: 91 - protein, 472 aa, Homo sapiens; identical to SEQ ID NO: 87

SEQ ID NO: 92 - protein, 433 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 93 - protein, 412 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 94 - protein, 396 aa, Homo sapiens
MMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 95 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 96 - protein, 208 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 97 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 98 - protein, 345 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 99 - protein, 272 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGASLQGRASEHSLFRSAVC

SEQ ID NO: 100 - protein, 214 aa, Homo sapiens
MAQHHLWILLLCLQTCRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 101 - protein, 339 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 102 - protein, 328 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 103 - protein, 217 aa, Homo sapiens
MDPQCTMGLSNILFVMAFLLSANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 104 - protein, 247 aa, Homo sapiens
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 105 - protein, 323 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 106 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 107 - protein, 275 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 108 - protein, 169 aa, Homo sapiens
MARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 109 - protein, 160 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENDG

SEQ ID NO: 110 - protein, 184 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENEQGEVDMESHRNANAEPAVQRTLLEK

SEQ ID NO: 111 - protein, 168 aa, Homo sapiens
MARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENEQGEVDMESHRNANAEPAVQRTLLEK

SEQ ID NO: 112 - protein, 185 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 113 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 114 - protein, 366 aa, Homo sapiens
MEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 115 - protein, 227 aa, Homo sapiens
MALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 116 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 117 - protein, 788 aa, Homo sapiens
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 118 - protein, 693 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTTLTSL

SEQ ID NO: 119 - protein, 796 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 120 - protein, 790 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 121 - protein, 630 aa, Homo sapiens
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLGRYCFQGLL

SEQ ID NO: 122 - protein, 785 aa, Homo sapiens
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 123 - protein, 785 aa, Homo sapiens; identical to SEQ ID NO: 122

SEQ ID NO: 124 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 125 - protein, 701 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 126 - protein, 702 aa, Homo sapiens; identical to SEQ ID NO: 124

SEQ ID NO: 127 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 128 - protein, 687 aa, Homo sapiens
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFAAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 129 - protein, 517 aa, Homo sapiens
MPCPPLLSVPVRAAGEQDRWVREEVTWGGGPTVTGGWGWRAHLRSVSPPGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAHNLFELLNLHSLFVTSRGRAVGCVSWVEMKKAISNLTNPPAPK

SEQ ID NO: 130 - protein, 228 aa, Homo sapiens
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 131 - protein, 228 aa, Homo sapiens; identical to SEQ ID NO: 130

SEQ ID NO: 132 - protein, 261 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 133 - protein, 261 aa, Homo sapiens
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 134 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 135 - protein, 230 aa, Homo sapiens; identical to SEQ ID NO: 134

SEQ ID NO: 136 - protein, 230 aa, Homo sapiens; identical to SEQ ID NO: 134

SEQ ID NO: 137 - protein, 220 aa, Homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 138 - protein, 375 aa, Homo sapiens
MSDSKEPRVQQLGLLEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 139 - protein, 263 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 140 - protein, 332 aa, Homo sapiens
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 141 - protein, 232 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVERLCRHCPKDWTFFQGNCYFMSNSQRNWHDSVTACQEVRAQLVVIKTAEEQLPAVLEQWRTQQ

SEQ ID NO: 142 - protein, 353 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 143 - protein, 376 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 144 - protein, 296 aa, Homo sapiens
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQLPAVLEQWRTQQ

SEQ ID NO: 145 - protein, 399 aa, Homo sapiens
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 146 - protein, 707 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 147 - protein, 659 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 148 - protein, 1294 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 149 - protein, 1382 aa, Homo sapiens
MKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKRQTNVGRALTELGSRGPKYQVSLFRFCVGSWATGNTFFLSSIKPGSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 150 - protein, 870 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 151 - protein, 1406 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 152 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 153 - protein, 863 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEELPGPRQGQWLGQTSEMSRALTPHPCVQDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 154 - protein, 783 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQAGPPRRSAYFKDQIMLHPAPPNGLLCLFPITSVL

SEQ ID NO: 155 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 156 - protein, 524 aa, Homo sapiens
MSLLSLPWLGLRPVATSPWLLLLLVVGSWLLARILAWTYAFYNNCRRLQCFPQPPKRNWFWGHLGLITPTEEGLKNSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVSLQ

SEQ ID NO: 157 - protein, 142 aa, Homo sapiens
MKSDFYFQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 158 - protein, 166 aa, Homo sapiens
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 159 - protein, 186 aa, Homo sapiens
MKSDFYFQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 160 - protein, 195 aa, Homo sapiens
MAALKSWLSRSVTSFFRYRQCLCVPVVANFKKRCFSELIRPWHKTVTIGFGVTLCAVPIAQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 161 - protein, 239 aa, Homo sapiens
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 162 - protein, 186 aa, Homo sapiens; identical to SEQ ID NO: 159

SEQ ID NO: 163 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 164 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 165 - protein, 587 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 166 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 167 - protein, 1210 aa, Homo sapiens [sequence omitted]

SEQ ID NO: 168 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 169 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 170 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 171 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 172 - protein, 875 aa, Homo sapiens [sequence omitted]

SEQ ID NO: 173 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 174 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 175 - protein, 993 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 176 - protein, 279 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCERK

SEQ ID NO: 177 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 178 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 179 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 180 - protein, 1240 aa, Homo sapiens
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 181 - protein, 603 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 182 - protein, 1255 aa, Homo sapiens [sequence omitted]

SEQ ID NO: 183 - protein, 183 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 184 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 185 - protein, 304 aa, Homo sapiens
MAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 186 - protein, 425 aa, Homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 187 - protein, 352 aa, Homo sapiens
MENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 188 - protein, 374 aa, Homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 189 - protein, 735 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 190 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 191 - protein, 998 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNEEKMWFTQKYGSSKRKRNMQWPLTPGISGTRVPLSSTLKLRWRQPRFPDPCSWLPQLLTDESTRLSNCCFSLCTPKFPLGEKQH

SEQ ID NO: 192 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 193 - protein, 719 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 194 - protein, 735 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 195 - protein, 704 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 196 - protein, 442 aa, Homo sapiens
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 197 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 198 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 199 - protein, 257 aa, Homo sapiens; identical to SEQ ID NO: 198

SEQ ID NO: 200 - protein, 257 aa, Homo sapiens; identical to SEQ ID NO: 198

SEQ ID NO: 201 - protein, 257 aa, Homo sapiens; identical to SEQ ID NO: 198

SEQ ID NO: 202 - protein, 144 aa, Homo sapiens
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 203 - protein, 96 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSG

SEQ ID NO: 204 - protein, 61 aa, Homo sapiens
MQKVTLGLLVFLAGFPVLDANDLEDKNSPFYYGESPCPLSPPHNPTYCLVPRVPIQGWGLT

SEQ ID NO: 205 - protein, 61 aa, Homo sapiens; identical to SEQ ID NO: 204

SEQ ID NO: 206 - protein, 87 aa, Homo sapiens
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 207 - protein, 113 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 208 - protein, 87 aa, Homo sapiens; identical to SEQ ID NO: 206

SEQ ID NO: 209 - protein, 113 aa, Homo sapiens; identical to SEQ ID NO: 207

SEQ ID NO: 210 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 211 - protein, 534 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 212 - protein, 330 aa, Homo sapiens
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 213 - protein, 330 aa, Homo sapiens; identical to SEQ ID NO: 212

SEQ ID NO: 214 - protein, 330 aa, Homo sapiens; identical to SEQ ID NO: 212

SEQ ID NO: 215 - protein, 330 aa, Homo sapiens; identical to SEQ ID NO: 212

SEQ ID NO: 216 - protein, 603 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTETEKKIWHFKYPIFFLCIGLDLQIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 217 - protein, 526 aa, Homo sapiens
MAGTVRTACLVVAMLLSLDFPGQAQPPPPPPDATCHQVRSFFQRLQPGLKWVPETPVPEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 218 - protein, 580 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 219 - protein, 271 aa, Homo sapiens
MTDLEGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 220 - protein, 278 aa, Homo sapiens
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 221 - protein, 278 aa, Homo sapiens; identical to SEQ ID NO: 220

SEQ ID NO: 222 - protein, 267 aa, Homo sapiens
MGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 223 - protein, 246 aa, Homo sapiens
MGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 224 - protein, 328 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 225 - protein, 305 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 226 - protein, 265 aa, Homo sapiens
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 227 - protein, 355 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRSILISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 228 - protein, 355 aa, Homo sapiens; identical to SEQ ID NO: 227

SEQ ID NO: 229 - protein, 355 aa, Homo sapiens; identical to SEQ ID NO: 227

SEQ ID NO: 230 - protein, 355 aa, Homo sapiens; identical to SEQ ID NO: 227

SEQ ID NO: 231 - protein, 355 aa, Homo sapiens; identical to SEQ ID NO: 227

SEQ ID NO: 232 - protein, 355 aa, Homo sapiens; identical to SEQ ID NO: 227

SEQ ID NO: 233 - protein, 415 aa, Homo sapiens
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWIFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 234 - protein, 384 aa, Homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 235 - protein, 981 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEETPALHPAACQCSALGPRTPLKEPSMLLVKVPSTRVQVAFSRTSLRQVCPFLLQHQLSSLYWIQATNVQICCHFSSLKPSPDLTFPPSHRPLSSLLFTALAAVGGLPDASSFFFPPISSCPPLQSGIGPCHSTEATLVTSNFHV

SEQ ID NO: 236 - protein, 980 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 237 - protein, 1381 aa, Homo sapiens
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 238 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 239 - protein, 436 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLARELGAVSLQDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 240 - protein, 458 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 241 - protein, 361 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 242 - protein, 167 aa, Homo sapiens
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 243 - protein, 167 aa, Homo sapiens; identical to SEQ ID NO: 242

SEQ ID NO: 244 - protein, 355 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 245 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 246 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 247 - protein, 200 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 248 - protein, 176 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSIFTTEYQVAVAGCVFLLISVLLLSGLTWQRRQRKSRRTI

SEQ ID NO: 249 - protein, 300 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 250 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 251 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 252 - protein, 788 aa, Homo sapiens; identical to SEQ ID NO: 251

SEQ ID NO: 253 - protein, 681 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 254 - protein, 746 aa, Homo sapiens
MITYKNFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 255 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 256 - protein, 529 aa, Homo sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 257 - protein, 858 aa, Homo sapiens [sequence omitted]

SEQ ID NO: 258 - protein, 221 aa, Homo sapiens
MHFLTIYPNCSSGVVRAQSRTEQKNPLGLDDLGIQNLGQTVSLAPAVEAASMLKMEPLNSTHPGTAASSSPLESRAAGGGSGNGNEYFYILVVMSFYGIFLIGIMLGYMKSKRREKKSSLLLLYKDEERLWGEAMKPLPVVSGLRSVQVPLMLNMLQESVAPALSCTLCSMEGDSVSSESSSPDVHLTIQEEGADDELEETSETPLNESSEGSSENIHQNS

SEQ ID NO: 259 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 260 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 261 - protein, 389 aa, Homo sapiens
MPTVYLCSEQIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 262 - protein, 372 aa, Homo sapiens; identical to SEQ ID NO: 260

SEQ ID NO: 263 - protein, 372 aa, Homo sapiens; identical to SEQ ID NO: 260

SEQ ID NO: 264 - protein, 418 aa, Homo sapiens
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 265 - protein, 453 aa, Homo sapiens
MLKMVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 266 - protein, 453 aa, Homo sapiens; identical to SEQ ID NO: 265

SEQ ID NO: 267 - protein, 418 aa, Homo sapiens; identical to SEQ ID NO: 264

SEQ ID NO: 268 - protein, 418 aa, Homo sapiens; identical to SEQ ID NO: 264

SEQ ID NO: 269 - protein, 453 aa, Homo sapiens; identical to SEQ ID NO: 265

SEQ ID NO: 270 - protein, 453 aa, Homo sapiens; identical to SEQ ID NO: 265

SEQ ID NO: 271 - protein, 453 aa, Homo sapiens; identical to SEQ ID NO: 265

SEQ ID NO: 272 - protein, 419 aa, Homo sapiens
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 273 - protein, 330 aa, Homo sapiens
MRRPSVRAAGLVLCTLCYLLVGAAVFDALESEAESGRQRLLVQKRGALRRKFGFSAEDYRELERLALQAEPHRAGRQWKFPGSFYFAITVITTIEYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARTPSPRPPGAPESRGLWLPRRPARSVGSASVFCHVHKLERCARDNLGFSPPSSPGVVRGGQAPRLGARWKSI

SEQ ID NO: 274 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 275 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 276 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 277 - protein, 1248 aa, Homo sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 278 - protein, 1257 aa, Homo sapiens; identical to SEQ ID NO: 276

SEQ ID NO: 279 - protein, 1253 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 280 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 281 - protein, 1097 aa, Homo sapiens; identical to SEQ ID NO: 280

SEQ ID NO: 282 - protein, 614 aa, Homo sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 283 - protein, 614 aa, Homo sapiens; identical to SEQ ID NO: 282

SEQ ID NO: 284 - protein, 614 aa, Homo sapiens; identical to SEQ ID NO: 282

SEQ ID NO: 285 - protein, 614 aa, Homo sapiens; identical to SEQ ID NO: 282

SEQ ID NO: 286 - protein, 614 aa, Homo sapiens; identical to SEQ ID NO: 282

SEQ ID NO: 287 - protein, 614 aa, Homo sapiens; identical to SEQ ID NO: 282

SEQ ID NO: 288 - protein, 614 aa, Homo sapiens; identical to SEQ ID NO: 282

SEQ ID NO: 289 - protein, 614 aa, Homo sapiens; identical to SEQ ID NO: 282

SEQ ID NO: 290 - protein, 614 aa, Homo sapiens; identical to SEQ ID NO: 282

SEQ ID NO: 291 - protein, 614 aa, Homo sapiens; identical to SEQ ID NO: 282

SEQ ID NO: 292 - protein, 614 aa, Homo sapiens; identical to SEQ ID NO: 282

SEQ ID NO: 293 - protein, 620 aa, Homo sapiens
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 294 - protein, 351 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 295 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 296 - protein, 858 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 297 - protein, 858 aa, Homo sapiens; identical to SEQ ID NO: 296

SEQ ID NO: 298 - protein, 796 aa, Homo sapiens
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 299 - protein, 667 aa, Homo sapiens
MVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 300 - protein, 796 aa, Homo sapiens; identical to SEQ ID NO: 298

SEQ ID NO: 301 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 302 - protein, 629 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 303 - protein, 541 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGMYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 304 - protein, 630 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 305 - protein, 649 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 306 - protein, 581 aa, Homo sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 307 - protein, 309 aa, Homo sapiens
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 308 - protein, 367 aa, Homo sapiens
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 309 - protein, 153 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 310 - protein, 111 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 311 - protein, 97 aa, Homo sapiens
MAPAAATGGSTLPSGFSVFTTLPDLLFIFEFDAAYHCTAALFYLSASVLEALATITMQDGFTYRHYHENIAAVVFSYIATLLYVVHAVFSLIRWKSS

SEQ ID NO: 312 - protein, 55 aa, Homo sapiens
MAPAAATGGSTLPSGFSVFTTLPDLLFIFEFVFSYIATLLYVVHAVFSLIRWKSS

SEQ ID NO: 313 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 314 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 315 - protein, 377 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 316 - protein, 377 aa, Homo sapiens; identical to SEQ ID NO: 315

SEQ ID NO: 317 - protein, 582 aa, Homo sapiens
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 318 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 319 - protein, 622 aa, Homo sapiens; identical to SEQ ID NO: 318

SEQ ID NO: 320 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 321 - protein, 264 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 322 - protein, 255 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 323 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 324 - protein, 150 aa, Homo sapiens
MTPGTQSPFFLLLLLTVLTVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 325 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 326 - protein, 158 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVWGWGARLGHRAAGAGLCSGCAGHCLSHCLGCLSVPPKELRAAGHLSSPGYLPSYERVPHLPHPWALCAP

SEQ ID NO: 327 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 328 - protein, 484 aa, Homo sapiens
MTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 329 - protein, 282 aa, Homo sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 330 - protein, 219 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVWGWGARLGHRAAGAGLCSGCAGHCLSHCLGCLSVPPKELRAAGHLSSPGYLPSYERVPHLPHPWALCAP

SEQ ID NO: 331 - protein, 238 aa, Homo sapiens
MTPGTQSPFFLLLLLTVLTATTAPKPATVVTGSGHASSTPGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 332 - protein, 217 aa, Homo sapiens
MTPGTQSPFFLLLLLTVLTGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 333 - protein, 241 aa, Homo sapiens
MTPGTQSPFFLLLLLTVLTATTAPKPATVVTGSGHASSTPGGEKETSATQRSSVPSSTEKNAFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 334 - protein, 239 aa, Homo sapiens
MTPGTQSPFFLLLLLTVLTATTAPKPATVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 335 - protein, 198 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 336 - protein, 230 aa, Homo sapiens
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 337 - protein, 189 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 338 - protein, 212 aa, Homo sapiens
MTPGTQSPFFLLLLLTVLTATTAPKPATVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 339 - protein, 177 aa, Homo sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 340 - protein, 273 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 341 - protein, 512 aa, Homo sapiens
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 342 - protein, 1738 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILRACTRQRMLSGSFEGQPAKERSILSVQHHIRQERRSLRHGSNSQRISRGKSLETLTQDHSNTVRYRNAQREDSEIKMIQEKKEQAEMKRKVQEEELRENHPYFDKPLFIVGREHRFRNFCRVVVRARFNASKTDPVTGAVKNTKYHQLYDLLGLVTYLDWVMIIVTICSCISMMFESPFRRVMHAPTLQIAEYVFVIFMSIELNLKIMADGLFFTPTAVIRDFGGVMDIFIYLVSLIFLCWMPQNVPAESGAQLLMVLRCLRPLRIFKLVPQMRKVVRELFSGFKEIFLVSILLLTLMLVFASFGVQLFAGKLAKCNDPNIIRREDCNGIFRINVSVSKNLNLKLRPGEKKPGFWVPRVWANPRNFNFDNVGNAMLALFEVLSLKGWVEVRDVIIHRVGPIHGIYIHVFVFLGCMIGLTLFVGVVIANFNENKGTALLTVDQRRWEDLKSRLKIAQPLHLPPRPDNDGFRAKMYDITQHPFFKRTIALLVLAQSVLLSVKWDVEDPVTVPLATMSVVFTFIFVLEVTMKIIAMSPAGFWQSRRNRYDLLVTSLGVVWVVLHFALLNAYTYMMGACVIVFRFFSICGKHVTLKMLLLTVVVSMYKSFFIIVGMFLLLLCYAFAGVVLFGTVKYGENINRHANFSSAGKAITVLFRIVTGEDWNKIMHDCMVQPPFCTPDEFTYWATDCGNYAGALMYFCSFYVIIAYIMLNLLVAIIVENFSLFYSTEEDQLLSYNDLRHFQIIWNMVDDKREGVIPTFRVKFLLRLLRGRLEVDLDKDKLLFKHMCYEMERLHNGGDVTFHDVLSMLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDESGDDLLDI

SEQ ID NO: 343 - protein, 391 aa, Homo sapiens
MKVLGHRLELLTGLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 344 - protein, 369 aa, Homo sapiens
MPECWDGVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 345 - protein, 357 aa, Homo sapiens
MPECWDGRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 346 - protein, 352 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 347 - protein, 339 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 348 - protein, 371 aa, Homo sapiens
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 349 - protein, 371 aa, Homo sapiens; identical to SEQ ID NO: 348

SEQ ID NO: 350 - protein, 823 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 351 - protein, 808 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 352 - protein, 711 aa, Homo sapiens
MLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 353 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 354 - protein, 848 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 355 - protein, 816 aa, Homo sapiens
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 356 - protein, 816 aa, Homo sapiens; identical to SEQ ID NO: 355

SEQ ID NO: 357 - protein, 816 aa, Homo sapiens; identical to SEQ ID NO: 355

SEQ ID NO: 358 - protein, 816 aa, Homo sapiens; identical to SEQ ID NO: 355

SEQ ID NO: 359 - protein, 538 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 360 - protein, 554 aa, Homo sapiens
MNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 361 - protein, 504 aa, Homo sapiens
MCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 362 - protein, 599 aa, Homo sapiens
MGEMWRKREEVIFREYSFSFYPLNIFAPFVLFPDYFCLLGFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 363 - protein, 514 aa, Homo sapiens
MNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 364 - protein, 578 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 365 - protein, 430 aa, Homo sapiens
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 366 - protein, 1304 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 367 - protein, 1211 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 368 - protein, 1192 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 369 - protein, 1180 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 370 - protein, 1183 aa, Homo sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 371 - protein, 644 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 372 - protein, 609 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSGIK

SEQ ID NO: 373 - protein, 906 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 374 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 375 - protein, 160 aa, Homo sapiens
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGWLSQDTKAEPLDPEADSHVEVFGDEPEQQLSPIFRNASGQSWFSPPASPFGQSSVQTIQPKRDS

SEQ ID NO: 376 - protein, 204 aa, Homo sapiens
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGEFLVLDQRAADYNQALGTCRLAGTALCVAAGVLLAICLFWAMIGWLSQDTKAEPLDPEADSHVEVFGDEPEQQLSPIFRNASGQSWFSPPASPFGQSSVQTIQPKRDS

SEQ ID NO: 377 - protein, 204 aa, Homo sapiens; identical to SEQ ID NO: 376

SEQ ID NO: 378 - protein, 204 aa, Homo sapiens; identical to SEQ ID NO: 376

SEQ ID NO: 379 - protein, 204 aa, Homo sapiens; identical to SEQ ID NO: 376

SEQ ID NO: 380 - protein, 204 aa, Homo sapiens; identical to SEQ ID NO: 376

SEQ ID NO: 381 - protein, 204 aa, Homo sapiens; identical to SEQ ID NO: 376

SEQ ID NO: 382 - protein, 204 aa, Homo sapiens; identical to SEQ ID NO: 376

SEQ ID NO: 383 - protein, 477 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 384 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 385 - protein, 553 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTWPRGSPKTA

SEQ ID NO: 386 - protein, 537 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTWPRGSPKTA

SEQ ID NO: 387 - protein, 838 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 388 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 389 - protein, 567 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTCFREIMLNPISLPGHSKPLNHGIYVEDVNVYFSKGRHGF

SEQ ID NO: 390 - protein, 617 aa, Homo sapiens
MELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVVQA

SEQ ID NO: 391 - protein, 825 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 392 - protein, 399 aa, Homo sapiens
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 393 - protein, 377 aa, Homo sapiens
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFLSGGDVPFHHPWLLPLWCYASGVLLTFAMSCTAHVFSCLSLRLRAAFFYLDYASISYYGFGSTVAYYYYLLPGLSLLDARVMTPYLQQRLGWHVDCTRLIAAYRALVLPVAFVLAVACTVACCKSRTDWCTYPFALRTFVFVMPLSMACPIMLESWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKK

SEQ ID NO: 394 - protein, 1195 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYEPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 395 - protein, 1161 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 396 - protein, 1203 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQSQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 397 - protein, 1237 aa, Homo sapiens
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYESQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 398 - protein, 800 aa, Homo sapiens
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 399 - protein, 1089 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 400 - protein, 1089 aa, Homo sapiens; identical to SEQ ID NO: 399

SEQ ID NO: 401 - protein, 120 aa, Homo sapiens
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 402 - protein, 118 aa, Homo sapiens
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 403 - protein, 238 aa, Homo sapiens
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 404 - protein, 236 aa, Homo sapiens
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 405 - protein, 137 aa, Homo sapiens
MTMETLPKVLEVDEKSPEAKDLLPSQTASSLCISSRSESVWTTTPRSNWEIYRKPIVIMSVGGAILLFGVVITCLAYTLKLSDKSLSILKMVGPGFLSLGLMMLVCGLVWVPIIKKKQKHRQKSNFLRSLKSFFLTR

SEQ ID NO: 406 - protein, 575 aa, Homo sapiens
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 407 - protein, 668 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 408 - protein, 626 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 409 - protein, 619 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 410 - protein, 661 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 411 - protein, 259 aa, Homo sapiens
MPAIPAHGAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 412 - protein, 287 aa, Homo sapiens
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 413 - protein, 252 aa, Homo sapiens
MAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 414 - protein, 237 aa, Homo sapiens
MMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 415 - protein, 237 aa, Homo sapiens; identical to SEQ ID NO: 414

SEQ ID NO: 416 - protein, 271 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 417 - protein, 193 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGSCLFGPWLHDVLLGGQAALLHREWAGKELAALCCHPALVLRHDDCPVPHVRLQASLARFLCGWSHRPHFCIHLLQTALSSSGQHSLP

SEQ ID NO: 418 - protein, 208 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLVAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 419 - protein, 96 aa, Homo sapiens
MRELAIEIGVRALLFGVFVFTEFLDPFQRVIQPEEIWLYKNPLVQSDNIPTRLMFLPFRALASRRSTWRASCTASPRVGGERAGGSVLPSCPCTAP

SEQ ID NO: 420 - protein, 96 aa, Homo sapiens
MRELAIEIGVRALLFGVFVFTEFLDPFQRVIQPEEIWLYKNPLVQSDNIPTRLMFIPLWVESSASFLHTFATDSTILLWPTQLAINPTLVCESQPH

SEQ ID NO: 421 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 422 - protein, 856 aa, Homo sapiens; identical to SEQ ID NO: 421

SEQ ID NO: 423 - protein, 842 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 424 - protein, 834 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 425 - protein, 833 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 426 - protein, 825 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 427 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 428 - protein, 439 aa, Homo sapiens
MHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 429 - protein, 550 aa, Homo sapiens
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 430 - protein, 1455 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 431 - protein, 1448 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFEEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 432 - protein, 2315 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 433 - protein, 148 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 434 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 435 - protein, 1114 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 436 - protein, 393 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 437 - protein, 937 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 438 - protein, 432 aa, Homo sapiens
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVPETAARWGFCTSWSPASQFHWSSLAFSSWFACAGISRRHLRPHRSGDS

SEQ ID NO: 439 - protein, 943 aa, Homo sapiens
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 440 - protein, 1951 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 441 - protein, 1951 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 442 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 443 - protein, 215 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 444 - protein, 215 aa, Homo sapiens; identical to SEQ ID NO: 443

SEQ ID NO: 445 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 446 - protein, 94 aa, Homo sapiens
MPGAGDGGKAPARWLGTGLLVEEVDNTVTLIILAVVGGVIGLLILILLIKKLIIFILKKTREKKKECLVSSSGNDNTENGLPGSKAEEKPPSKV

SEQ ID NO: 447 - protein, 118 aa, Homo sapiens
MNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 448 - protein, 228 aa, Homo sapiens
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 449 - protein, 669 aa, Homo sapiens
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 450 - protein, 692 aa, Homo sapiens
MSSIKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 451 - protein, 728 aa, Homo sapiens
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 452 - protein, 1074 aa, Homo sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 453 - protein, 1151 aa, Homo sapiens
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 454 - protein, 1151 aa, Homo sapiens; identical to SEQ ID NO: 453

SEQ ID NO: 455 - protein, 1205 aa, Homo sapiens
MLHLSAEEAIGCVRVRRSFIDELAFGRGHSTGTGKQKRRDRVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 456 - protein, 993 aa, Homo sapiens
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGETREYEVSI

SEQ ID NO: 457 - protein, 869 aa, Homo sapiens
MAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 458 - protein, 994 aa, Homo sapiens
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 459 - protein, 627 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEDRSNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 460 - protein, 626 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEESNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 461 - protein, 439 aa, Homo sapiens
MLKREGKVQPYTKTLDGGWGWMIVIHFFLVNVFVMGMTKTFAIFFVVFQEEFEGTSEQIGWIGSIMSSLRFCAGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 462 - protein, 425 aa, Homo sapiens
MGMDDCDSFFPGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 463 - protein, 382 aa, Homo sapiens
MGMDDCDSFFPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAEIIPSFQAGYMIIPRHTMALSTSLAYAISSLQFPFFLYHWPKDGKTV

SEQ ID NO: 464 - protein, 319 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 465 - protein, 487 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 466 - protein, 478 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQDFESGWRNVFFLSAAVNMFGLVFYLTFGQAELQDWAKERTLTRL

SEQ ID NO: 467 - protein, 398 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRLGQFIEHLQVAGF

SEQ ID NO: 468 - protein, 436 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 469 - protein, 497 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITIRDRLRTTTNVLGDSLGAGIVEHLSRHELKNRDVEMGNSVIEENEMKKPYQLIAQDNETEKPIDSETKM

SEQ ID NO: 470 - protein, 430 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 471 - protein, 542 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 472 - protein, 555 aa, Homo sapiens
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 473 - protein, 791 aa, Homo sapiens
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 474 - protein, 887 aa, Homo sapiens
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTALESLSAAGGCYPYRSESLVSPLFTRQALAAMDKPPAHSTPPTSALSLAAEGHLDFQLLRVSQKQKDKYNCAGLLYKLQKVSQSPHGSVSDGVRLSRT

SEQ ID NO: 475 - protein, 691 aa, Homo sapiens
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 476 - protein, 691 aa, Homo sapiens; identical to SEQ ID NO: 475

SEQ ID NO: 477 - protein, 617 aa, Homo sapiens
MVPVENTEGPSLLNQKGTAVETEGSGSRHPPWARGCGMFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 478 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 479 - protein, 405 aa, Homo sapiens
MHLNRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 480 - protein, 351 aa, Homo sapiens
MYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 481 - protein, 485 aa, Homo sapiens
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 482 - protein, 487 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 483 - protein, 487 aa, Homo sapiens; identical to SEQ ID NO: 482

SEQ ID NO: 484 - protein, 487 aa, Homo sapiens; identical to SEQ ID NO: 482

SEQ ID NO: 485 - protein, 487 aa, Homo sapiens; identical to SEQ ID NO: 482

SEQ ID NO: 486 - protein, 487 aa, Homo sapiens; identical to SEQ ID NO: 482

SEQ ID NO: 487 - protein, 521 aa, Homo sapiens
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTGRDTMEMCTQRKGHARTQQEGNCLQAKGRGLRRTKRVHTLILHFPTSRTVSK

SEQ ID NO: 488 - protein, 456 aa, Homo sapiens
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 489 - protein, 685 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 490 - protein, 431 aa, Homo sapiens
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGALFSAVACVNSLAMLTASGIFNSLYPATLNFMKGFPFLLGAGLLLIPAVLIGMLEKADPHLEFQQFPQSP

SEQ ID NO: 491 - protein, 459 aa, Homo sapiens
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 492 - protein, 635 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGSSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 493 - protein, 599 aa, Homo sapiens [sequence omitted]

SEQ ID NO: 494 - protein, 599 aa, Homo sapiens [sequence omitted]

SEQ ID NO: 495 - protein, 642 aa, Homo sapiens
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 496 - protein, 630 aa, Homo sapiens
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 497 - protein, 298 aa, Homo sapiens
MERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 498 - protein, 925 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 499 - protein, 924 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 500 - protein, 921 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 501 - protein, 284 aa, Homo sapiens
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 502 - protein, 927 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 503 - protein, 691 aa, Homo sapiens
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 504 - protein, 724 aa, Homo sapiens
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 505 - protein, 188 aa, Homo sapiens
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 506 - protein, 188 aa, Homo sapiens; identical to SEQ ID NO: 505

SEQ ID NO: 507 - protein, 395 aa, Homo sapiens
MASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 508 - protein, 418 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 509 - protein, 2551 aa, Homo sapiens
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 510 - protein, 426 aa, Homo sapiens
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 511 - protein, 850 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 512 - protein, 850 aa, Homo sapiens; identical to SEQ ID NO: 511

SEQ ID NO: 513 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 514 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 515 - protein, 161 aa, Homo sapiens; identical to SEQ ID NO: 514

SEQ ID NO: 516 - protein, 161 aa, Homo sapiens; identical to SEQ ID NO: 514

SEQ ID NO: 517 - protein, 134 aa, Homo sapiens
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 518 - protein, 134 aa, Homo sapiens; identical to SEQ ID NO: 517

SEQ ID NO: 519 - protein, 233 aa, Homo sapiens
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQEKNQRPTHLAGAFLAFILGNVYFWLQLLLWRLKRLPQPGAAWIGPLRLGLCSVCTILIVAMIVLHACSLRSVSAACEWVVAMLLFALFGLLAVDFSALESCTLCVQPWPSLSPPPASPISLPVQL

SEQ ID NO: 520 - protein, 233 aa, Homo sapiens; identical to SEQ ID NO: 519

SEQ ID NO: 521 - protein, 198 aa, Homo sapiens
MELPDPVRQRLGNFSRAVFSDSNRTGPESNEGPENEMVSSLALQMSLYFNTYYFPLWWVSSIMMLHMKYSILPDYYKFIVITVIILITLIEAIRLYLGYVGNLQEKVPELAGFWLLSLLLQLPLILFLLFNEGLTNLPLEKAIHIIFTLFLAFQVVAAFLTLRKMVNQLAVRFHLQDFDRLSANRGDMRRMRSCIEEI

SEQ ID NO: 522 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 523 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 524 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 525 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 526 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 527 - protein, 420 aa, Homo sapiens; identical to SEQ ID NO: 526

SEQ ID NO: 528 - protein, 219 aa, Homo sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 529 - protein, 230 aa, Homo sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 530 - protein, 1104 aa, Homo sapiens
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 531 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 532 - protein, 253 aa, Homo sapiens
MAHYKTEQDDWLIIYLKYLLFVFNFFFWVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 533 - protein, 523 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 534 - protein, 423 aa, Homo sapiens
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 535 - protein, 387 aa, Homo sapiens
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 536 - protein, 187 aa, Homo sapiens
MFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 537 - protein, 166 aa, Homo sapiens
MASLGQILFWSIISIIIILAGAIALIIGFGISAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 538 - protein, 282 aa, Homo sapiens
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 539 - protein, 543 aa, Homo sapiens
MAGAIIENMSTKKLCIVGGILLVFQIIAFLVGGLIGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 540 - protein, 450 aa, Homo sapiens
MAGAIIENMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 541 - protein, 541 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 542 - protein, 114 aa, Homo sapiens
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 543 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

What is claimed is:

1. An in vitro or ex vivo genetically modified cytotoxic immune cell, wherein the cytotoxic immune cell is genetically modified to produce: (a) a binding triggered transcriptional switch (BTTS) that recognizes PTPRZ1, and (b) an antigen-specific therapeutic that recognizes IL13RA2, wherein binding of the BTTS to PTPRZ1 induces expression of the antigen-specific therapeutic by the cell.

2. The cell of claim 1, wherein: the antigen-specific therapeutic is a chimeric antigen receptor (CAR) that recognizes IL13RA2, wherein binding of the BTTS to PTPRZ1 induces expression of the CAR by the cell.

3. The cell of claim 2, wherein the BTTS comprises:

an extracellular domain that comprises binding domains that bind to PTPRZ1;

a transmembrane domain, one or more protease cleavage domains; and a transcriptional activator, wherein binding of the extracellular domain to PTPRZ1 results in cleavage of the BTTS at the one or more protease cleavage domains to release the transcriptional activator, and wherein the released transcriptional activator activates expression of the CAR.

* * * * *